United States Patent
Rozenfeld et al.

(10) Patent No.: US 12,280,120 B2
(45) Date of Patent: Apr. 22, 2025

(54) TUMOR-SPECIFIC CLEAVABLE LINKERS

(71) Applicant: Xilio Development, Inc., Waltham, MA (US)

(72) Inventors: Raphael Rozenfeld, Swampscott, MA (US); Ugur Eskiocak, Somerville, MA (US); Huawei Qiu, Westborough, MA (US); Parker Johnson, Allston, MA (US); Kurt Allen Jenkins, Weymouth, MA (US); Magali Pederzoli-Ribeil, Cambridge, MA (US); Dheeraj Singh Tomar, Dorchester, MA (US); Rebekah Kay O'Donnell, Brookline, MA (US)

(73) Assignee: Xilio Development, Inc., Waltham, MA (US)

( * ) Notice: Subject to any disclaimer, the term of this patent is extended or adjusted under 35 U.S.C. 154(b) by 0 days.

(21) Appl. No.: 17/535,451

(22) Filed: Nov. 24, 2021

(65) Prior Publication Data

US 2023/0072822 A1 Mar. 9, 2023

Related U.S. Application Data

(60) Provisional application No. 63/253,090, filed on Oct. 6, 2021, provisional application No. 63/118,585, filed on Nov. 25, 2020.

(51) Int. Cl.
*A61K 47/65* (2017.01)
*A61K 38/20* (2006.01)
*A61K 47/64* (2017.01)
*A61P 35/00* (2006.01)

(52) U.S. Cl.
CPC .......... *A61K 47/65* (2017.08); *A61K 38/2013* (2013.01); *A61K 38/208* (2013.01); *A61K 38/2086* (2013.01); *A61K 47/64* (2017.08); *A61P 35/00* (2018.01)

(58) Field of Classification Search
CPC .... A61K 47/65; A61K 47/64; A61K 38/2013; A61K 38/208; A61K 38/2086; A61P 35/00
See application file for complete search history.

(56) References Cited

U.S. PATENT DOCUMENTS

| | | |
|---|---|---|
| RE30,985 E | 6/1982 | Cartaya |
| 4,419,446 A | 12/1983 | Howley et al. |
| 4,560,655 A | 12/1985 | Baker |
| 4,601,978 A | 7/1986 | Karin |
| 4,657,866 A | 4/1987 | Kumar |
| 4,676,980 A | 6/1987 | Segal et al. |
| 4,767,704 A | 8/1988 | Cleveland |
| 4,816,567 A | 3/1989 | Cabilly et al. |
| 4,927,762 A | 5/1990 | Darfler |
| 4,965,199 A | 10/1990 | Capon et al. |
| 5,122,464 A | 6/1992 | Wilson et al. |
| 5,122,469 A | 6/1992 | Mather et al. |
| 5,208,020 A | 5/1993 | Chari et al. |
| 5,264,365 A | 11/1993 | Georgiou |
| 5,416,064 A | 5/1995 | Chari et al. |
| 5,508,192 A | 4/1996 | Georgiou et al. |
| 5,571,894 A | 11/1996 | Weis et al. |
| 5,587,458 A | 12/1996 | King et al. |
| 5,624,821 A | 4/1997 | Winter et al. |
| 5,635,483 A | 6/1997 | Pettit et al. |
| 5,639,635 A | 6/1997 | Joly et al. |
| 5,641,870 A | 6/1997 | Rinderknecht et al. |
| 5,648,237 A | 7/1997 | Carter et al. |
| 5,648,260 A | 7/1997 | Winter et al. |
| 5,650,150 A | 7/1997 | Gillies |
| 5,712,374 A | 1/1998 | Kunstmann et al. |
| 5,714,586 A | 2/1998 | Kunstmann et al. |
| 5,739,277 A | 4/1998 | Presta et al. |
| 5,767,285 A | 6/1998 | Hamann et al. |
| 5,770,701 A | 6/1998 | McGahren et al. |
| 5,770,710 A | 6/1998 | McGahren et al. |
| 5,773,001 A | 6/1998 | Hamann et al. |
| 5,780,588 A | 7/1998 | Pettit et al. |
| 5,834,597 A | 11/1998 | Tso et al. |
| 5,869,046 A | 2/1999 | Presta et al. |
| 5,877,296 A | 3/1999 | Hamann et al. |
| 5,891,693 A | 4/1999 | Bebbington et al. |
| 5,939,598 A | 8/1999 | Kucherlapati et al. |
| 6,027,888 A | 2/2000 | Georgiou et al. |
| 6,075,181 A | 6/2000 | Kucherlapati et al. |
| 6,083,715 A | 7/2000 | Georgiou et al. |

(Continued)

FOREIGN PATENT DOCUMENTS

| | | |
|---|---|---|
| CN | 103002913 A | 3/2013 |
| CN | 105229031 A | 1/2016 |
| CN | 108218993 A | 6/2018 |
| EP | 0425235 B1 | 9/1996 |
| EP | 2639241 A2 | 9/2019 |
| EP | 3093295 B1 | 5/2020 |
| EP | 3740501 A1 | 11/2020 |
| EP | 3762406 A2 | 1/2021 |
| EP | 3773674 A1 | 2/2021 |
| EP | 3792277 A1 | 3/2021 |
| EP | 3810171 A1 | 4/2021 |
| JP | S63203626 A | 8/1988 |
| JP | 2004508828 A | 3/2004 |
| JP | 2021530243 A | 11/2021 |

(Continued)

OTHER PUBLICATIONS

Diguanylate cyclase [*Parafrankia* sp. BMG5.11], from https://www.ncbi.nlm.nih.gov/protein/TCJ40027.1?report=genbank&log$=protalign&blast_rank=6&RID=A7PHCH8P013, 2019, pp. 1-3.*

(Continued)

*Primary Examiner* — Li N Komatsu
(74) *Attorney, Agent, or Firm* — Proskauer Rose LLP

(57) ABSTRACT

The present disclosure provides tumor-specific cleavable linkers and their use in drugs and prodrugs for delivering therapeutics to a tumor cell environment. The present disclosure also provides cleavage products of said drugs and prodrugs, and methods related to the use of the same.

11 Claims, 112 Drawing Sheets
Specification includes a Sequence Listing.

(56) References Cited

U.S. PATENT DOCUMENTS

| | | |
|---|---|---|
| 6,114,598 A | 9/2000 | Kucherlapati et al. |
| 6,150,584 A | 11/2000 | Kucherlapati et al. |
| 6,162,963 A | 12/2000 | Kucherlapati et al. |
| 6,165,745 A | 12/2000 | Ward et al. |
| 6,194,551 B1 | 2/2001 | Idusogie et al. |
| 6,248,516 B1 | 6/2001 | Winter et al. |
| 6,602,684 B1 | 8/2003 | Umana et al. |
| 6,630,579 B2 | 10/2003 | Chari et al. |
| 6,821,505 B2 | 11/2004 | Ward et al. |
| 6,942,853 B2 | 9/2005 | Chernajovsky et al. |
| 7,498,298 B2 | 3/2009 | Doronina et al. |
| 8,399,219 B2 | 3/2013 | Stagliano et al. |
| 8,507,222 B2 | 8/2013 | Wong et al. |
| 9,206,243 B2 | 12/2015 | Monzon et al. |
| 9,428,573 B2 | 8/2016 | Wong et al. |
| 9,975,937 B2 | 5/2018 | Pavlakis et al. |
| 10,106,621 B2 | 10/2018 | Cobbold et al. |
| 10,150,805 B2 | 12/2018 | Wong et al. |
| 10,184,009 B2 | 1/2019 | Ast et al. |
| 10,206,980 B2 | 2/2019 | Qu et al. |
| 10,350,270 B2 | 7/2019 | Mccauley |
| 10,358,477 B2 | 7/2019 | Jacques et al. |
| 10,501,543 B2 | 12/2019 | Bernett et al. |
| 10,604,576 B2 | 3/2020 | Campbell et al. |
| 10,906,952 B2 | 2/2021 | Gundram et al. |
| 11,053,294 B2 | 7/2021 | Karow et al. |
| 11,059,876 B2 | 7/2021 | Yeung et al. |
| 11,352,403 B2 | 6/2022 | Winston et al. |
| 11,357,826 B2 | 6/2022 | Xu et al. |
| 11,358,999 B2 | 6/2022 | Bernett et al. |
| 11,634,467 B2 | 4/2023 | Li et al. |
| 2002/0164328 A1 | 11/2002 | Shinkawa et al. |
| 2003/0115614 A1 | 6/2003 | Kanda et al. |
| 2003/0157108 A1 | 8/2003 | Presta et al. |
| 2003/0190311 A1 | 10/2003 | Dall'Acqua et al. |
| 2004/0053829 A1 | 3/2004 | Pfizenmaier et al. |
| 2004/0093621 A1 | 5/2004 | Shitara et al. |
| 2004/0109865 A1 | 6/2004 | Niwa et al. |
| 2004/0110282 A1 | 6/2004 | Kanda et al. |
| 2004/0110704 A1 | 6/2004 | Yamane et al. |
| 2004/0132140 A1 | 7/2004 | Satoh et al. |
| 2005/0014934 A1 | 1/2005 | Hinton et al. |
| 2005/0123546 A1 | 6/2005 | Umana et al. |
| 2006/0236411 A1 | 10/2006 | Dreher et al. |
| 2007/0048282 A1 | 3/2007 | Rosen et al. |
| 2007/0269422 A1 | 11/2007 | Beirnaert et al. |
| 2008/0311655 A1 | 12/2008 | Gillies et al. |
| 2010/0068175 A1 | 3/2010 | Gillies et al. |
| 2013/0089516 A1 | 4/2013 | Frelinger et al. |
| 2014/0053829 A1 | 2/2014 | Lee |
| 2014/0294823 A1 | 10/2014 | Moore et al. |
| 2014/0302037 A1 | 10/2014 | Borges et al. |
| 2015/0139984 A1 | 5/2015 | Brezski et al. |
| 2016/0152686 A1 | 6/2016 | Camphausen et al. |
| 2016/0194665 A1 | 7/2016 | Collingwood et al. |
| 2016/0200645 A1 | 7/2016 | Henri et al. |
| 2017/0020963 A1 | 1/2017 | Qu et al. |
| 2017/0240608 A1 | 8/2017 | Stagliano et al. |
| 2018/0118833 A1 | 5/2018 | Hofer et al. |
| 2019/0263877 A1 | 8/2019 | Yeung et al. |
| 2019/0367576 A1 | 12/2019 | Winston et al. |
| 2019/0391152 A1 | 12/2019 | Abrignani et al. |
| 2020/0308242 A1 | 10/2020 | Lowe et al. |
| 2020/0392235 A1 | 12/2020 | Lu et al. |
| 2020/0399338 A1 | 12/2020 | Caffaro et al. |
| 2021/0024631 A1 | 1/2021 | Kley et al. |
| 2021/0061871 A1 | 3/2021 | Niazi et al. |
| 2021/0115102 A1 | 4/2021 | Winston et al. |
| 2021/0139553 A1 | 5/2021 | Li et al. |
| 2021/0221864 A1 | 7/2021 | Williams et al. |
| 2021/0238308 A1 | 8/2021 | Ikawa et al. |
| 2021/0260163 A1 | 8/2021 | Yu et al. |
| 2021/0355208 A1 | 11/2021 | Moore et al. |
| 2022/0002370 A1 | 1/2022 | Karow et al. |
| 2022/0025050 A1 | 1/2022 | Poirier et al. |
| 2022/0047714 A1 | 2/2022 | Mulligan et al. |
| 2023/0028959 A1 | 1/2023 | Karow et al. |
| 2023/0030037 A1 | 2/2023 | Karow et al. |

FOREIGN PATENT DOCUMENTS

| | | |
|---|---|---|
| WO | WO-87/00195 A1 | 1/1987 |
| WO | WO-90/03430 A1 | 4/1990 |
| WO | WO-91/01743 A1 | 2/1991 |
| WO | 9208495 A1 | 5/1992 |
| WO | WO-93/08829 A1 | 5/1993 |
| WO | WO-93/16185 A2 | 8/1993 |
| WO | WO-94/11026 A2 | 5/1994 |
| WO | WO-94/29351 A2 | 12/1994 |
| WO | WO-96/27011 A1 | 9/1996 |
| WO | WO-97/30087 A1 | 8/1997 |
| WO | WO-98/58964 A1 | 12/1998 |
| WO | WO-99/22764 A1 | 5/1999 |
| WO | 9927011 A2 | 6/1999 |
| WO | WO-99/51642 A1 | 10/1999 |
| WO | 0042072 A2 | 7/2000 |
| WO | WO-00/61739 A1 | 10/2000 |
| WO | 0129246 A1 | 4/2001 |
| WO | WO-01/79271 A1 | 10/2001 |
| WO | WO-02/43478 A2 | 6/2002 |
| WO | WO-02/076489 A1 | 10/2002 |
| WO | WO-03/011878 A2 | 2/2003 |
| WO | WO-03/59934 A2 | 7/2003 |
| WO | WO-03/084570 A1 | 10/2003 |
| WO | WO-03/085119 A1 | 10/2003 |
| WO | WO-2004/041865 A2 | 5/2004 |
| WO | WO-2004/056312 A2 | 7/2004 |
| WO | WO-2005/035586 A1 | 4/2005 |
| WO | WO-2005/035778 A1 | 4/2005 |
| WO | WO-2005/053742 A1 | 6/2005 |
| WO | WO-2006/106905 A1 | 10/2006 |
| WO | 2006133148 A2 | 12/2006 |
| WO | 2011100786 A1 | 8/2011 |
| WO | WO-2011/124718 A1 | 10/2011 |
| WO | WO-2012/059486 A1 | 5/2012 |
| WO | 2012107417 A1 | 8/2012 |
| WO | 2016154675 A1 | 10/2016 |
| WO | WO-2016/200645 A1 | 12/2016 |
| WO | 2017127514 A1 | 7/2017 |
| WO | 2017165464 A1 | 9/2017 |
| WO | WO-2018/071918 A1 | 4/2018 |
| WO | 2018151868 A2 | 8/2018 |
| WO | 2018184964 A1 | 10/2018 |
| WO | 2018184965 A1 | 10/2018 |
| WO | 2019129053 A1 | 7/2019 |
| WO | 2019166946 A1 | 9/2019 |
| WO | WO-2019/173832 A2 | 9/2019 |
| WO | 2019191295 A1 | 10/2019 |
| WO | WO-2019/214757 A1 | 11/2019 |
| WO | WO-2019/222294 A1 | 11/2019 |
| WO | WO-2019/222295 A1 | 11/2019 |
| WO | 2019246379 A1 | 12/2019 |
| WO | WO-2019/246392 A1 | 12/2019 |
| WO | 2020023702 A1 | 1/2020 |
| WO | 2020041758 A1 | 2/2020 |
| WO | 2020047299 A1 | 3/2020 |
| WO | 2020086758 A1 | 4/2020 |
| WO | WO-2020/069398 A1 | 4/2020 |
| WO | 2020088459 A1 | 5/2020 |
| WO | 2020123980 A1 | 6/2020 |
| WO | 2020146221 A1 | 7/2020 |
| WO | 2020232305 A1 | 11/2020 |
| WO | 2020259536 A1 | 12/2020 |
| WO | WO-2020/252264 A1 | 12/2020 |
| WO | 2021001289 A1 | 1/2021 |
| WO | 2021016640 A1 | 1/2021 |
| WO | WO-2021/016599 A1 | 1/2021 |
| WO | 2021030633 A1 | 2/2021 |
| WO | 2021035188 A1 | 2/2021 |
| WO | WO-2021/030483 A1 | 2/2021 |
| WO | 2021054867 A1 | 3/2021 |
| WO | 2021062406 A1 | 4/2021 |
| WO | 2021092719 A1 | 5/2021 |
| WO | 2021119429 A1 | 6/2021 |

(56) References Cited

FOREIGN PATENT DOCUMENTS

| WO | 2021119516 A1 | 6/2021 |
|---|---|---|
| WO | 2021127487 A2 | 6/2021 |
| WO | 2021127495 A1 | 6/2021 |
| WO | 2021142471 A1 | 7/2021 |
| WO | 2021142476 A1 | 7/2021 |
| WO | 2021149697 A1 | 7/2021 |
| WO | 2021150936 A1 | 7/2021 |
| WO | 2021189139 A1 | 9/2021 |
| WO | 2021202673 A2 | 10/2021 |
| WO | 2021202675 A1 | 10/2021 |
| WO | 2021202678 A1 | 10/2021 |
| WO | 2021216916 A1 | 10/2021 |
| WO | WO-2022/115865 A2 | 6/2022 |
| WO | 2024015960 A1 | 1/2024 |

OTHER PUBLICATIONS

Proteolytically cleavable peptide linker, from https://web.expasy.org/cgi-bin/peptide_cutter/peptidecutter.pl, accessed 2024, pp. 1-2.*
Diguanylate cyclase, from https://web.archive.org/web/20171107063802/https://enzyme.expasy.org/EC/2.7.7.65, 2017, pp. 1-2.*
Berry et al., Valine, Isoleucine, and Leucine a New Treatment for Phenylketonuria, AJDC, 1990, 144, pp. 539-543.*
Zaman et al, Current strategies in extending half-lives of therapeutic proteins, Journal of Controlled Release, 2019, 301, pp. 176-189.*
International Search Report for PCT/US2021/025107 dated Jul. 21, 2021 (4 pages).
International Search Report for PCT/US2023/014128 dated Aug. 21, 2023 (11 pages).
International Search Report for PCT/US2021/025100 dated Sep. 24, 2021 (6 pages).
International Search Report for PCT/US2023/070206 dated Oct. 18, 2023 (7 pages).
International Search Report for PCT/US2021/025103 dated Aug. 18, 2021 (7 pages).
"Remington: The Science and Practice of Pharmacy", Gennaro (Ed.), 20th Edition, 2000, Lippincott Williams & Wilkins, Philadelphia, PA.
Adams, Gill, et al., "Targeting cytokines to inflammation sites", Nature Biotechnology, vol. 21, No. 11, Nov. 2003, pp. 1314-1320, DOI: 10.1038/nbt888 (7 pages).
Berge, Stephen M., et al., "Pharmaceutical Salts", Journal of Pharmaceutical Sciences, vol. 66, No. 1, Jan. 1977, pp. 1-19, DOI: 10.1002/jps.2600660104, (19 pages).
Bothmann, Hendrick, et al., "The Periplasmic Escherichia coli Peptidylprolyl cis, trans-Isomerase FkpA", The Journal of Biological Chemistry, vol. 275, No. 22, Jun. 2, 2000, pp. 17100-17105 (7 pages).
Brodeur, Bernard R., et al., "Mouse-Human Myeloma Partners for the Production of Heterohybridomas", Monoclonal Antibody Production Techniques and Applications, Ch. 4, 1987, pp. 51-63 (13 pages).
Cameron, Mark J., et al., "Cytokines, Chemokines and Their Receptors", Madame Curie Bioscience Database [Internet], Austin (TX): Landes Bioscience; 2000-2013 (25 pages).
Chen, Xiaoying, et al., "Fusion Protein Linkers: Property, Design and Functionality", Advanced Drug Delivery Reviews, vol. 65, No. 10, Oct. 15, 2013, pp. 1357-1369, DOI: 10.1016/j.addr.2012.09.039, (32 pages).
Hsu, Eric J., et al., "A cytokine receptor-masked IL2 prodrug selectively activates tumor-infiltrating lymphocytes for potent antitumor therapy", Nature Communications, vol. 12, 2021, pp. 2768, DOI: 10.1038/s41467-021-22980-w (13 pages).
Kuen, Martin Matthias, "Antibody masked cytokines as new approach in targeted tumor therapy", Doctoral Dissertation, Aug. 2015 (126 pages).
Reichmann, Lutz, et al., "Reshaping human antibodies for therapy", Nature, vol. 332, 1988, pp. 323-327, DOI: 10.1038/332323a0 (5 pages).
Wüest, Thomas, et al., "TNF-Selectokine: a novel prodrug generated for tumor targeting and site-specific activation of tumor necrosis factor", Oncogene, vol. 21, 2002, pp. 4257-4265 (9 pages).
Ha, Ji-Hee et al., "Immunoglobulin Fc Heterodimer Platform Technology: From Design to Applications in Therapeutic Antibodies and Proteins", Frontiers in Immunology, vol. 7, No. 394, Oct. 6, 2016.
Skrombolas, D. et al., "Development of an Interleukin-12 Fusion Protein That Is Activated by Cleavage with Matrix Metalloproteinase 9", Journal of Interferon & Cytokine Research, vol. 39, No. 4, Apr. 1, 2019, pp. 233-245.
Arie et al. "Chaperone function of FkpA, a heat shock prolyl isomerase, in the periplasm of Escherichia coli," (2001) Mol. Microbial. 39: 199-210.
Atwell et al., "Stable heterodimers from remodeling the domain interface of a homodimer using a phage display library," J. Mol. Biol. (1997) 270(1): 26-35.
Bachmann, Cellular and Molecular Biology, vol. 2 (Washington, D.C.: American Society for Microbiology, 1987), pp. 1190-1219.
Barnes et al., "Methods for growth of cultured cells in serum-free medium," Anal. Biochem. 102: 255 (1980). 16 pages.
Bass et al., "Hormone phage: an enrichment method for variant proteins with altered binding properties," Proteins, 8: 309-314 (1990).
Bernett et al., "Potency-reduced IL15/IL15Rα heterodimeric Fc-fusions display enhanced in vivo activity through increased exposure," Xencor, AACR (2018) Abstract #5565. 1 page.
Boerner et al., "Production of antigen-specific human monoclonal antibodies from in vitro-primed human splenocytes," J. Immunol., 147: 86 (1991). 10 pages.
Bothmann and Pluckthun. "Improving Expression of scFv Fragments by Coexpression of Periplasmic Chaperones," (2000) J. Biol. Chem. 275: 17100-17105.
Brennan et al., "Preparation of bispecific antibodies by chemical recombination of monoclonal immunoglobulin G1 fragments," Science, 229: 81(1985). 3 pages.
Brodeur et al., Monoclonal Antibody Production Techniques and Applications, pp. 51-63 Marcel Dekker, Inc., New York, 1987.
Caescu et al., "Active site determinants of substrate recognition by the metalloproteinases TACE and ADAM10," Biochem. J. (2010) 424 (1): 79-88.
Carter et al., "High level Escherichia coli expression and production of a bivalent humanized antibody fragment," Bio/Technology 10: 163-167 (1992).
Carter et al. (2001), "Bispecific human IgG by design," J. Immunol. Methods, 248: 7-15.
Chapman et al. (1999) "Therapeutic antibody fragments with prolonged in vivo half-lives," Nature Biotechnol., 17: 780-783.
Chari et al., "Immunoconjugates containing novel maytansinoids: promising anticancer drugs," Cancer Res. 52:127-131 (1992).
Chen et al. (1999) "Chaperone activity of DsbC," J. Biol. Chem. 274:19601-19605.
Choe et al. (2016) "Fc-Binding Ligands of Immunoglobulin G: An Overview of High Affinity Proteins and Peptides," Materials 9(12): 994. 17 pages.
Cunningham and Wells (1989) "High-resolution epitope mapping of hGH-receptor interactions by alanine-scanning mutagenesis," Science, 244:1081-1085.
Davies et al., "Antibody-antigen complexes," Annual Rev Biochem. 59:439-473, (1990).
Dennis et al. (2002), "Albumin binding as a general strategy for improving the pharmacokinetics of proteins," JBC 277(38): 35035-35043.
Dubowchik et al., "Doxorubicin Immunoconjugates Containing Bivalent, Lysosomally-Cleavable Dipeptide Linkages," Bioorg. & Med. Chem. Letters 12:1529-1532 (2002).
Duncan and Winter, "The binding site for C1q on IgG," Nature 322: 738-40 (1988).
Damodaran (2010) "Protein PEGylation: An overview of chemistry and process considerations," European Pharmaceutical Review, 15(1): 18-26.

(56) References Cited

OTHER PUBLICATIONS

Firan, M., et al., "The MHC class I-related receptor, FcRn, plays an essential role in the maternofetal transfer of y-globulin in humans," Int. Immunol. 13 (2001) 993-1002.

Fishwild, D. et al. (1996) "High-avidity human IgG kappa monoclonal antibodies from a novel strain of minilocus transgenic mice," Nature Biotechnology 14: 845-851.

Graham et al., "Characteristics of a human cell line transformed by DNA from human adenovirus type 5," J. Gen Virol. 36:59 (1977). 14 pages.

Gunasekaran et al., "Enhancing antibody Fc heterodimer formation through electrostatic steering effects: applications to bispecific molecules and monovalent IgG," J Biol Chem. (2010) 285(25): 19637-19646.

Guss et al., "Structure of the IgG-binding regions of streptococcal protein G.," EMBO J. 5:1567-1575 (1986).

Guyer et al., "Immunoglobulin Binding by Mouse Intestinal Epithelial Cell Receptors," J. Immunol. 117:587 (1976). 7 pages.

Ham et al., "Media and Growth Requirements," Meth. Enz. 58:44 (1979). 50 pages.

Hara et al., "Overproduction of Penicillin-Binding Protein 7 Suppresses Thermosensitive Growth Defect at Low Osmolarity due to an spr Mutation of *Escherichia coli*," Microbial Drug Resistance, 2: 63-72 (1996).

Hinman et al., "Preparation and characterization of monoclonal antibody conjugates of the calicheamicins: a novel and potent family of antitumor antibiotics," Cancer Res. 53:3336-3342 (1993).

Hudson et al., (2003). "Engineered antibodies," Nat. Med., 9:129-134.

Idusogie et al., (2000). "Mapping of the C1q Binding Site on Rituxan, a Chimeric Antibody with a Human IgG1 Fc," J. Immunol., 164:4178-4184.

Imai-Nishiya et al., (2007). "Double knockdown of α1,6-fucosyltransferase (FUT8) and GDP-mannose 4,6-dehydratase (GMO) in antibody-producing cells: a new strategy for generating fully non-fucosylated therapeutic antibodies with enhanced ADCC," BMC Biotechnol., 7:84, 13 pages.

International Search Report and Written Opinion for PCT/US2019/053588, dated Jan. 23, 2020. 11 pages.

International Search Report and Written Opinion for PCT/US21/72603, dated May 24, 2022. 25 pages.

Jefferis et al., (2009). "Human immunoglobulin allotypes: Possible implications for immunogenicity," mAbs, 1(4):332-8.

Jeffrey et al., (2006). "Dipeptide-based highly potent doxorubicin antibody conjugates," Bioorganic & Med. Chem. Letters, 16:358-362.

Jones et al. (1986). "Replacing the complementarity-determining regions in a human antibody with those from a mouse," Nature, 321:522-525.

Kim et al., (1994). "Localization of the site of the murine IgG1 molecule that is involved in binding to the murine intestinal Fc receptor'," European Journal of Immunology, 24:2429-2434.

King et al., (2002). "Monoclonal Antibody Conjugates of Doxorubicin Prepared with Branched Peptide Linkers: Inhibition of Aggregation by Methoxytriethyleneglycol Chains," J. Med. Chem., 45:4336-4343.

Klein et al. (2012), "Progress in overcoming the chain association issue in bispecific heterodimeric IgG antibodies," MAbs, 4(6):653-663.

Kontermann et al., (2015). "Bispecific antibodies," Drug Discovery Today, 20(7):838-847.

Kozbor et al., (1984). "A human hybrid myeloma for production of human monoclonal antibodies," J. Immunol., 133:3001-5.

Kratz et al., (2006). "Prodrugs of anthracyclines in cancer chemotherapy," Current Med. Chem. 13:477-523.

Krieg et al. (2010). "Improved IL-2 immunotherapy by selective stimulation of IL-2 receptors on lymphocytes and endothelial cells," PNAS, 107(26):11906-11911.

Lehninger, in Biochemistry, second ed., pp. 73-75, Worth Publishers, New York (1975).

Lindmark et al., (1983). "Binding of immunoglobulins to protein A and immunoglobulin levels in mammalian sera," J. Immunol. Meth., 62:1-13.

Lode et al., (1998). "Targeted Therapy with a Novel Enediyene Antibiotic Calicheamicin θ11 Effectively Suppresses Growth and Dissemination of Liver Metastases in a Syngeneic Model of Murine Neuroblastoma," Cancer Res., 58:2925-2928.

Lonberg, et al. (1994). "Antigen-specific human antibodies from mice comprising four distinct genetic modifications," Nature 368:856-859.

Mather et al., (1982). "Culture of testicular cells in hormone-supplemented serum-free medium," Annals N.Y. Acad. Sci., 383:44-68.

Mather, (1980). "Establishment and characterization of two distinct mouse testicular epithelial cell lines," Biol. Reprod. 23:243-251.

Merchant et al., (1988). "An efficient route to human bispecific IgG," Nat. Biotechnol., 16(7):677-681.

Milstein et al., (1983). "Hybrid hybridomas and their use in immunohistochemistry," Nature, 305:537. 4 pages.

Moore et al. (2011). "A novel bispecific antibody format enables simultaneous bivalent and monovalent co-engagement of distinct target antigens," MAbs, 3(6): 546-557.

Mori et al., (2004). "Engineering Chinese hamster ovary cells to maximize effector function of produced antibodies using FUT8 siRNA," Biotechnol. Bioeng. 88(7):901-908.

Morimoto et al., (1992). "Single-step purification of F(ab')2 fragments of mouse monoclonal antibodies (immunoglobulins G1) by hydrophobic interaction high performance liquid chromatography using TSKgel Phenyl-5PW," Journal of Biochemical and Biophysical Methods, 24:107-117.

Nagy et al., (2000). "Stability of cytotoxic luteinizing hormone-releasing hormone conjugate (AN-152) containing doxorubicin 14-O-hemiglutarate in mouse and human serum in vitro: Implications for the design of preclinical studies," Proc. Natl. Acad. Sci. USA, 97:829-834.

Nilvebrant et al., (2013). "The albumin-binding domain as a scaffold for protein engineering," Comput. Struct. Biotechol. J., 6:e201303009, 8 pages.

Nygren et al., (1988). "Analysis and use of the serum albumin binding domains of streptococcal protein G," J. Mol. Recogn., 1(2):69-74.

Okazaki et al., (2004). "Fucose depletion from human IgG1 oligosaccharide enhances binding enthalpy and association rate between IgG1 and FcgammaRIIIa," J. Mol. Biol., 336:1239-1249.

Omasa et al., (2008). "Decrease in antithrombin III fucosylation by expressing GDP-fucose transporter siRNA in Chinese hamster ovary cells," J. Biosci. Bioeng., 106(2):168-173.

Podust et al., (2016). "Extension of in vivo half-life of biologically active molecules by XTEN protein polymers," J. Controlled Release, 240:52-66.

Proba et al., (1995). "Functional antibody single-chain fragments from the cytoplasm of *Escherichia coli*: influence of thioredoxin reductase (TrxB)," Gene, 159:203-7.

Puskas et al., "Development of an attenuated interleukin-2 fusion protein that can be activated by tumour-expressed proteases," Immunology (2011) 133: 206-220.

Ramm et al., (2000). "The periplasmic *Escherichia coli* peptidylprolyl cis, trans-isomerase FkpA II. Isomerase-independent chaperone activity in vitro," J. Biol. Chem., 275:17106-17113.

Reyes et al., (1982). "Expression of human B-interferon cDNA under the control of a thymidine kinase promoter from herpes simplex virus," Nature, 297:598-601.

Riechmann et al. (1988). "Reshaping human antibodies for therapy," Nature, 332:323-327.

Ridgway et al., (1996). "Knobs-into-holes' engineering of antibody CH3 domains for heavy chain heterodimerization," Protein Eng., 9(7):617-621.

Ripka et al., (1986). "Two chinese hamster ovary glycosylation mutants affected in the conversion of GDP-man nose to GDP-fucose," Arch. Biochem. Biophys., 249:533-545.

(56) References Cited

OTHER PUBLICATIONS

Roux et al., (1998). "Comparisons of the ability of human IgG3 hinge mutants, IgM, IgE, and IgA2, to form small immune complexes: a role for flexibility and geometry," J Immunol, 161:4083-90.

Sali et al. (2015). "Characterization of a Novel Human-Specific STING Agonist that Elicits Antiviral Activity Against Emerging Alphaviruses," PloS Pathog., 11(12) :e1005324, 30 pages.

Schlapschy et al. (2013). "PASylation: a biological alternative to PEGylation for extending the plasma half-life of pharmaceutically active proteins," Protein Eng. Des. Sel., 26(8):489-501.

Shields et al, (2001). "High resolution mapping of the binding site on human IgG1 for Fc gamma RI, Fc gamma RII, Fc gamma RIII, and FcRn and design of IgG1 variants with improved binding to the Fc gamma R," J. Biol. Chem., 276:6591-6604.

Shields et al., (2002). "Lack of fucose on human IgG1 N-linked oligosaccharide improves binding to human Fcgamma RIII and antibody-dependent cellular toxicity," J. Biol. Chem., 277(30):26733-40.

Shinkawa et al., (2003). "The absence of fucose but not the presence of galactose or bisecting N-acetylglucosamine of human IgG1 complex-type oligosaccharides shows the critical role of enhancing antibody-dependent cellular cytotoxicity," J. Biol. Chem., 278(5):3466-73.

Siebenlist et al., (1980). "*E.coli* RNA polymerase interacts homologously with two different promoters," Cell 20:269-281.

Simmons et al., (2002). "Expression of full-length immunoglobulins in *Escherichia coli*: rapid and efficient production of aglycosylated antibodies," J. Immunol. Methods, 263:133-147.

Sola et al. (2007), "Modulation of protein biophysical properties by chemical glycosylation: biochemical insights and biomedical implications," Cell. Mol. Life Sci., 64(16):2133-2152.

Sola et al., (2009), "Effects of Glycosylation on the Stability of Protein Pharmaceuticals," J. Pharm. Sci., 98(4): 1223-1245.

Stites et al. (eds), Basic and Clinical Immunology, 8th Edition, Appleton & Lange, Norwalk, CT, 1994, p. 71 and Chapter 6. 1 page.

Suresh et al., (1986). "Bispecific monoclonal antibodies from hybrid hybridomas," Methods in Enzymology, 121:210-228.

Tomizuka et al., (2000). "Double trans-chromosomic mice: Maintenance of two individual human chromosome fragments containing Ig heavy and K loci and expression of fully human antibodies," Proc. Natl. Acad. Sci. USA, 97:722-727.

Torgov et al., (2005). "Generation of an Intensely Potent Anthracycline by a Monoclonal Antibody-β-Galactosidase Conjugate," Bioconj. Chem., 16:717-721.

Traunecker et al., (1991). "Bispecific single chain molecules (Janusins) target cytotoxic lymphocytes on HIV infected cells," EMBO J., 10:3655-3659.

U.S. Appl. No. 17/279,407, filed (Int'l) Sep. 27, 2019, by Karow et al. (a copy is not submitted herewith pursuant to the waiver of 37 C.F.R. § 1.98 (a)(2)(iii) issued by the Office on Sep. 21, 2004).

Urlaub et al., (1980). "Isolation of Chinese hamster cell mutants deficient in dihydrofolate reductase activity," Proc. Natl. Acad. Sci. USA, 77:4216-4220.

Verhoeyen et al., (1988). "Reshaping human antibodies: grafting an antilysozyme activity," Science, 239:1534-1536.

Vitetta et al., (1987). "Redesigning nature's poisons to create anti-tumor reagents," Science, 238:1098-1104.

Yamane-Ohnuki et al., (2004). "Establishment of FUT8 knockout Chinese hamster ovary cells: an ideal host cell line for producing completely defucosylated antibodies with enhanced antibody-dependent cellular cytotoxicity," Biotech. Bioeng., 87:614-22.

Yamane-Ohnuki et al., (2009). "Production of therapeutic antibodies with controlled fucosylation," MAbs, 1(3):230-236.

Yang et al., (2003). "Tailoring structure+function and pharmacokinetic properties of single-chain Fv proteins by site-specific PEGylation," Protein Eng., 16(10):761-770.

Yaniv, (1982). "Enhancing elements for activation of eukaryotic promoters," Nature 297:17-18 (1982).

Yeung et al., (2009). "Engineering Human IgG1 Affinity to Human Neonatal Fc Receptor: Impact of Affinity Improvement on Pharmacokinetics in Primates," J. Immunol., 182:7667-7671.

Zapata et al., (1995). "Engineering linear F(ab')2 fragments for efficient production in *Escherichia coli* and enhanced antiproliferative activity," Protein Eng., 8(10):1057-1062.

\* cited by examiner

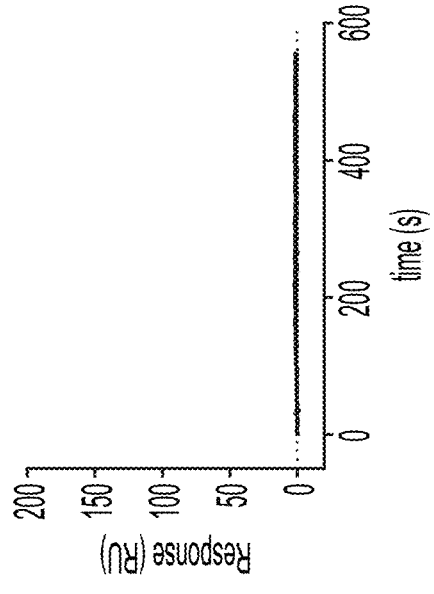
FIG. 5A
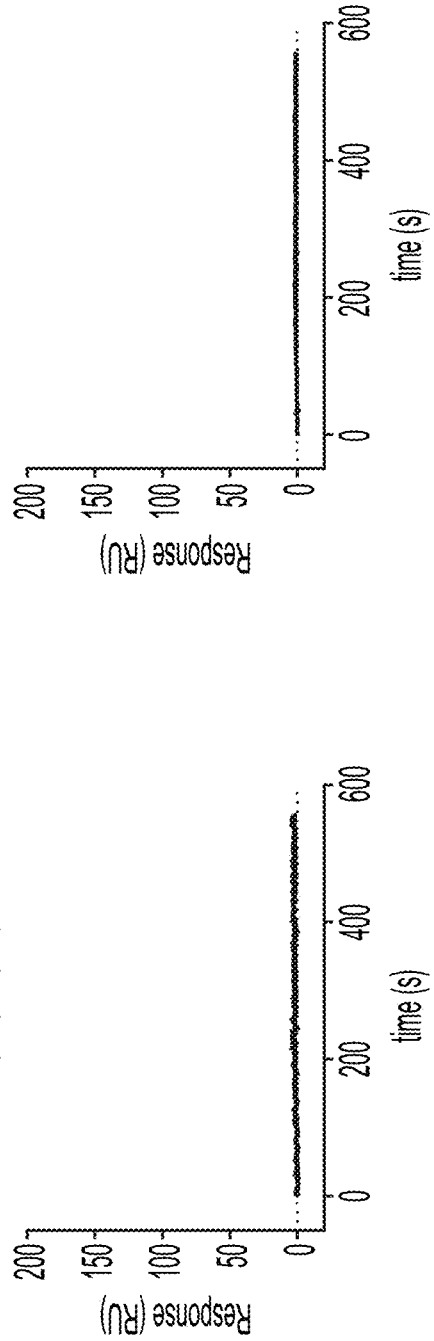
FIG. 5B
FIG. 5C
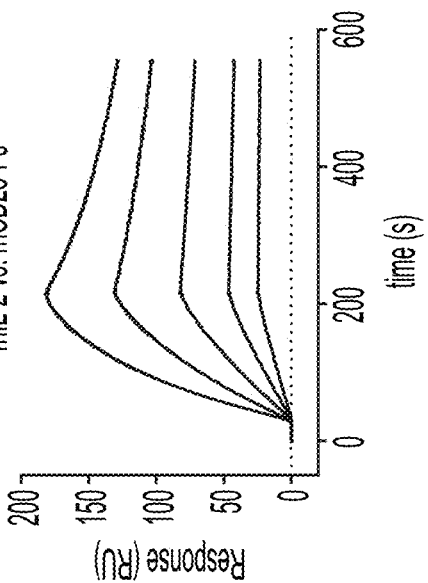
FIG. 5D
| Sample | ka (1/(M*s)) | kd (1/s) | KD | Chi2 | U-value: kd (%) |
|---|---|---|---|---|---|
| AK168 | ND | ND | ND | ND | ND |
| AK168 + MMP | ND | ND | ND | ND | ND |
| rhIL-2 | 8.30e+5 | 7.29e-4 | 0.878 nM | 7.01 | 3.1 |

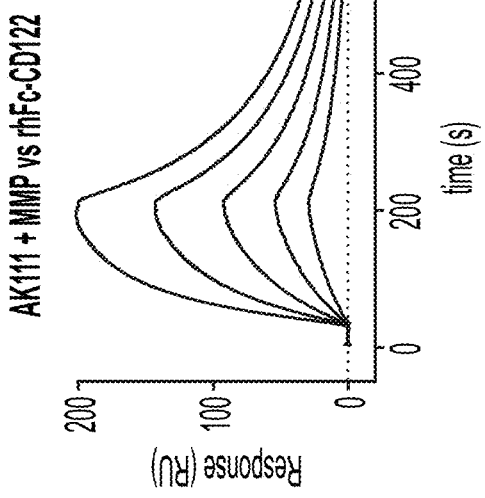
FIG. 6A
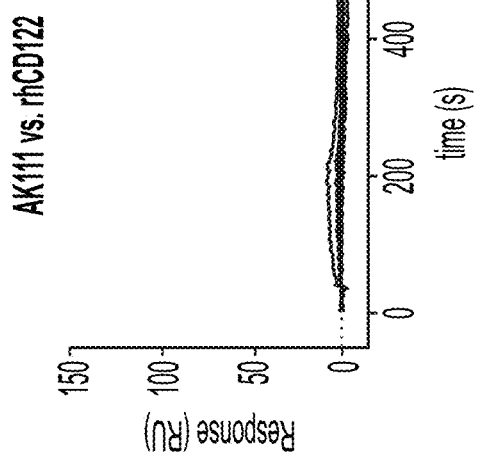
FIG. 6B
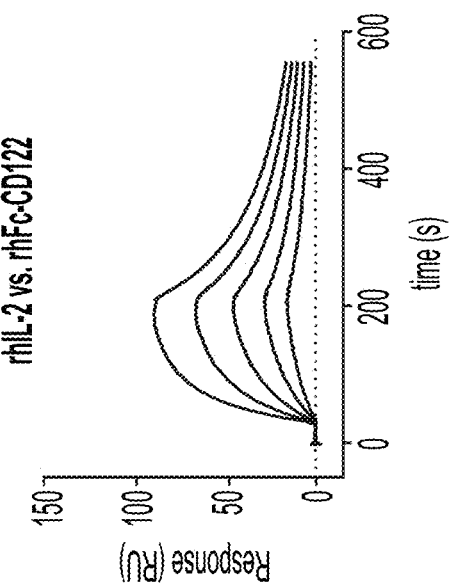
FIG. 6C
FIG. 6D
| Sample | ka (1/(M*s)) | kd (1/s) | KD | Chi2 | U-value: kd (%) |
|---|---|---|---|---|---|
| AK111 | ND | ND | ND | ND | ND |
| AK111 + MMP | 2.64e+4 | 6.21e-3 | 235 nM | 9.82 | 0.6 |
| rhIL-2 | 4.17e+4 | 5.17e-3 | 124 nM | 2.09 | 0.8 |

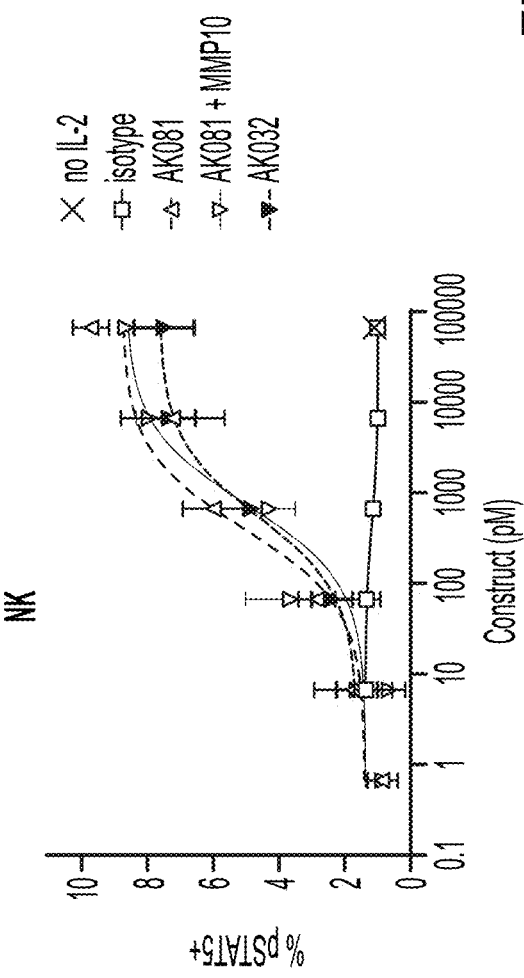
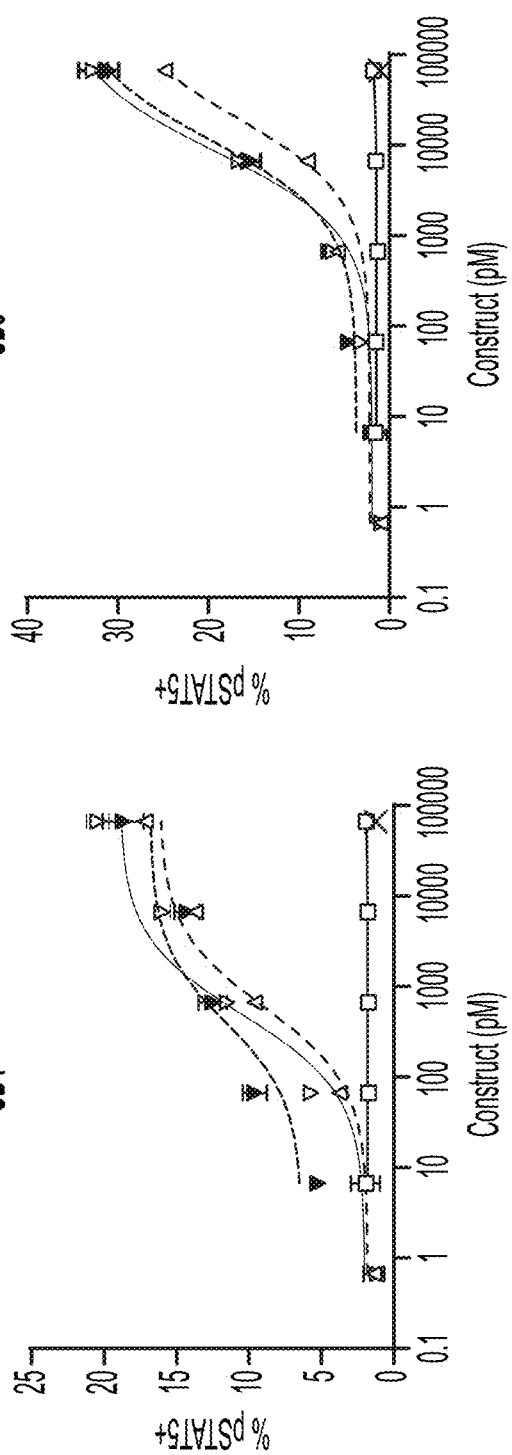
FIG. 9A
FIG. 9B
FIG. 9C

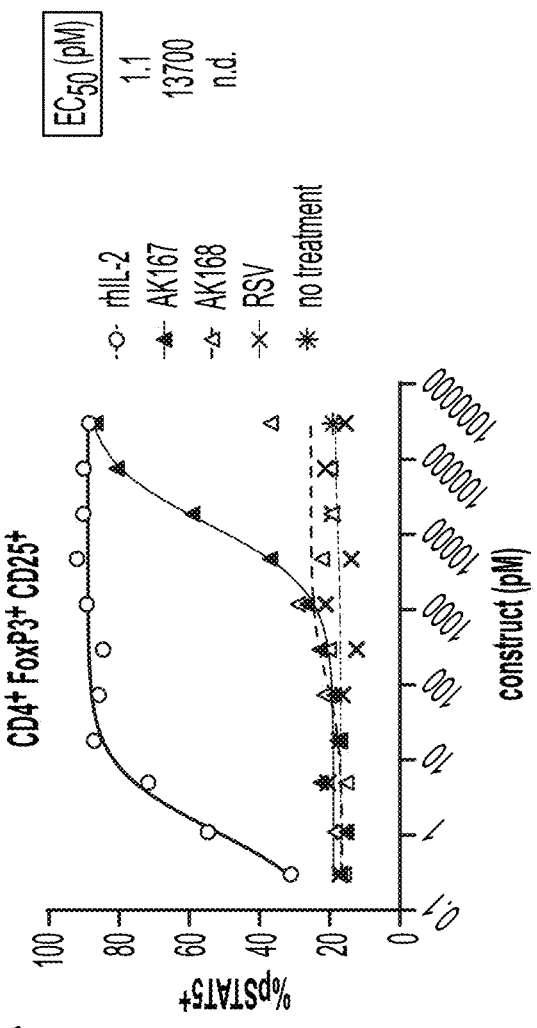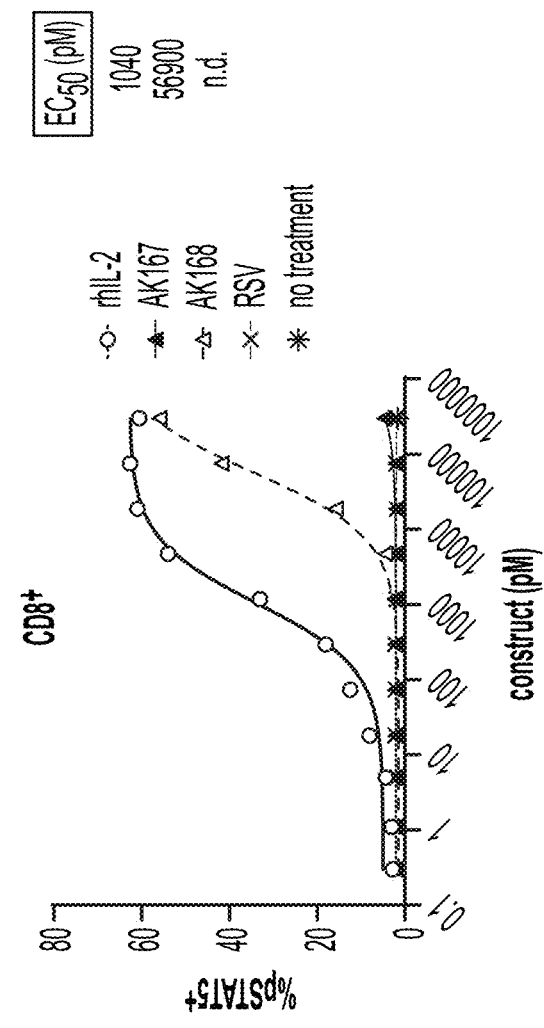
FIG. 11A
FIG. 11B

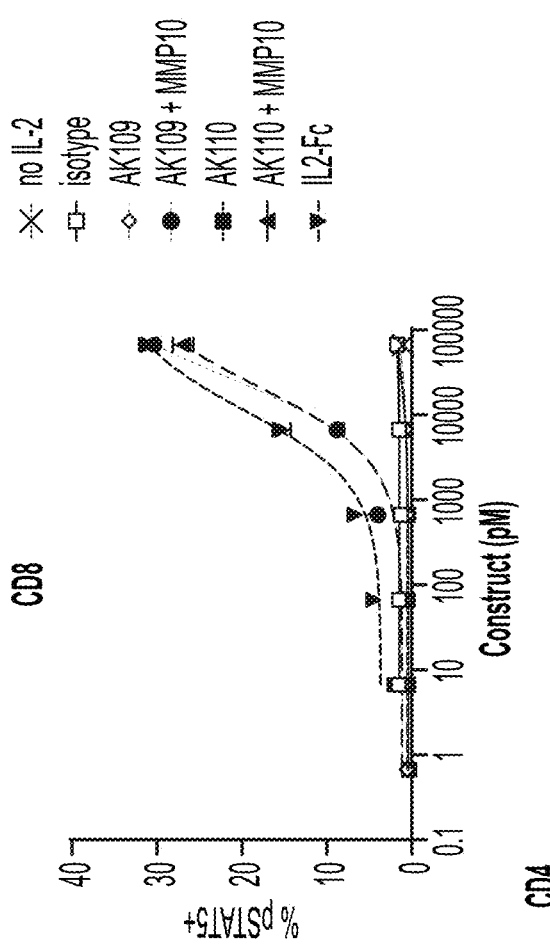
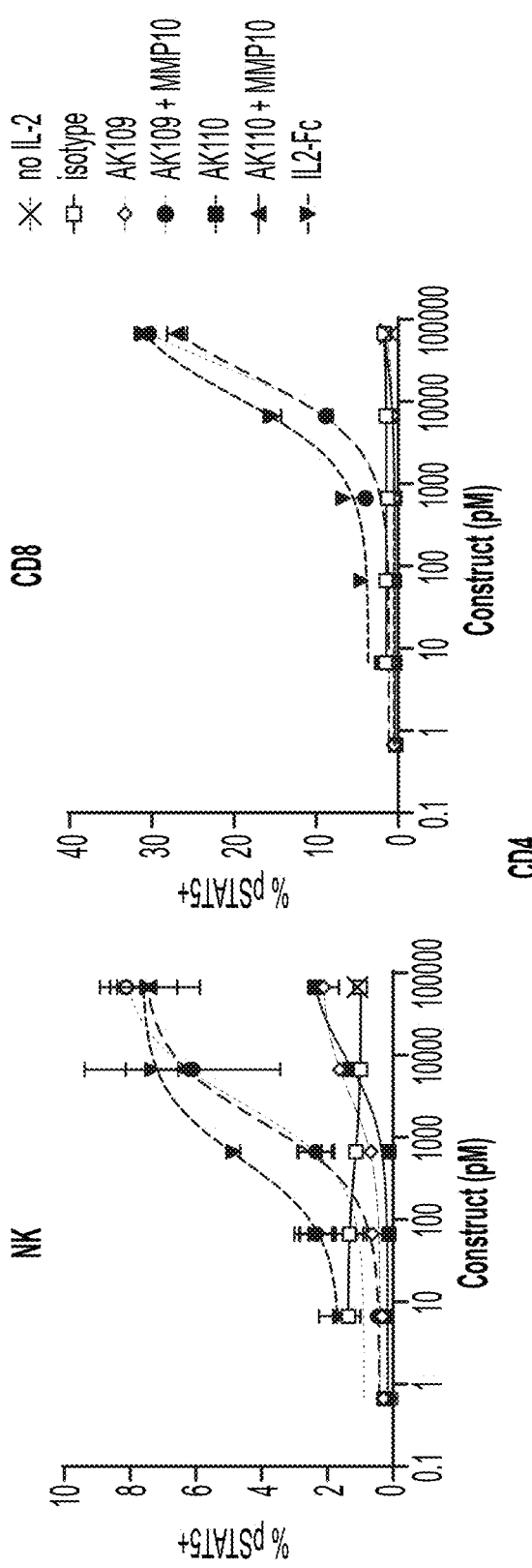
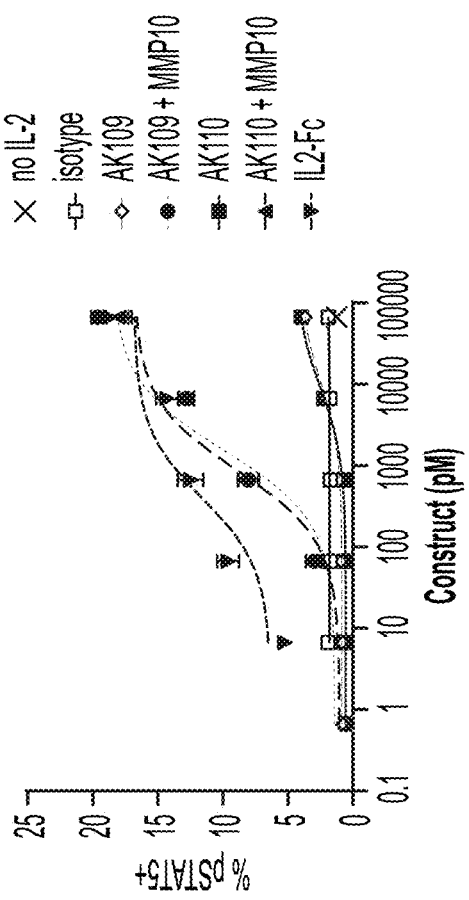
FIG. 13A
FIG. 13B
FIG. 13C

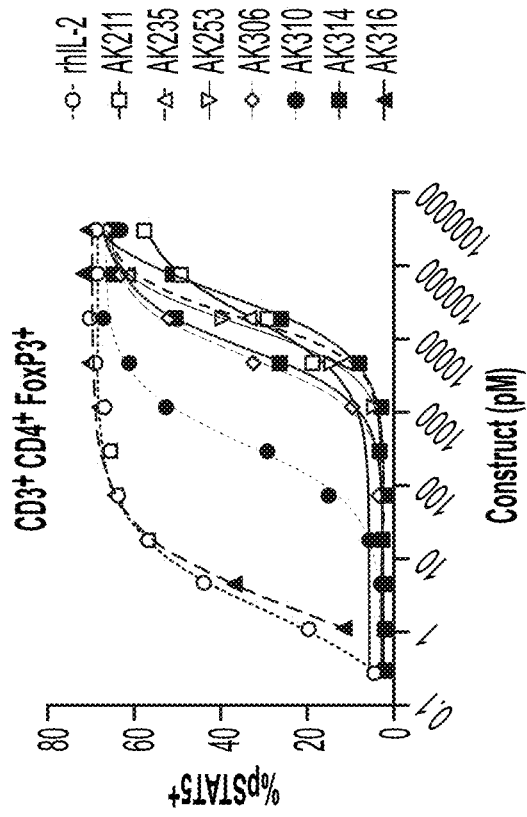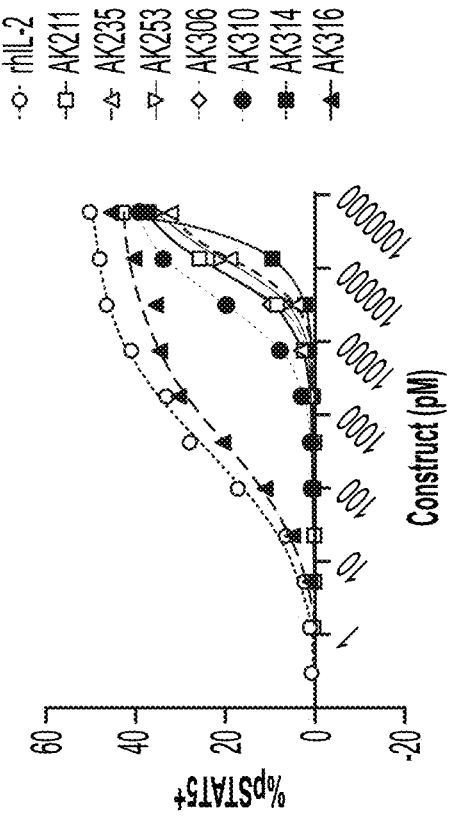
FIG. 14A
FIG. 14B

| Construct | CD3+ CD4+ FoxP3+ EC$_{50}$ (pM) | CD3+ CD4+ FoxP3- EC$_{50}$ (pM) | CD3+ CD8+ EC$_{50}$ (pM) |
|---|---|---|---|
| rhIL-2 | 1.94 | 247 | 2300 |
| AK211 | 39500 | * | 164000 |
| AK253 | 15400 | 75100 | 46400 |
| AK235 | 19200 | 69500 | 44100 |
| AK314 | 7250 | 49400 | 29500 |
| AK306 | 5680 | 56300 | 28800 |
| AK310 | 373 | 20800 | 22300 |
| AK316 | 1.73 | 331 | 167000** |

| Construct | FoxP3+ Treg EC50 (pM) | CD4+ Thelp EC50 (pM) | CD8+ Tcyto EC50 (pM) |
|---|---|---|---|
| rhIL-2 | 1.67 | 154 | 2710 |
| AK081 | 3.59 | 332 | 6700 |
| AK167 | 4390 | 22900 | 13200 |
| AK216 | 1020 | 9200 | 5490 |
| AK218 | 86.7 | 5270 | 7550 |
| AK219 | 117 | 5030 | 4570 |
| AK220 | 782 | 10900 | 7650 |
| AK223 | 3040 | 20200 | 12600 |

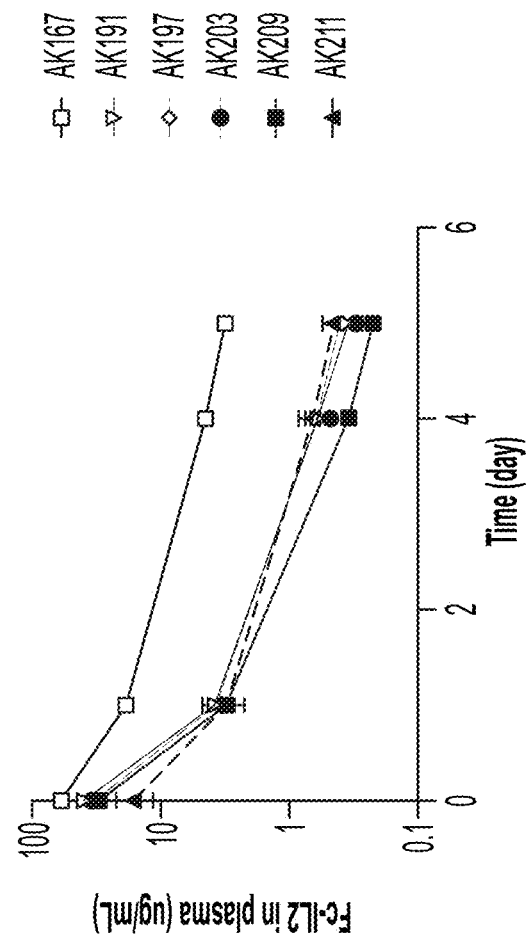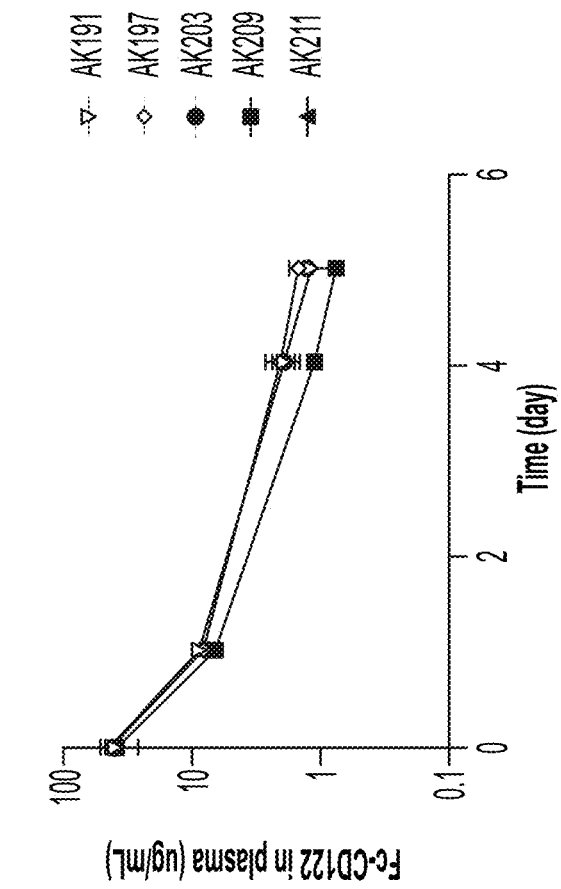
FIG. 19C
FIG. 19D

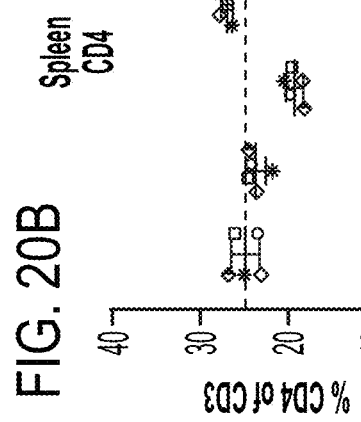
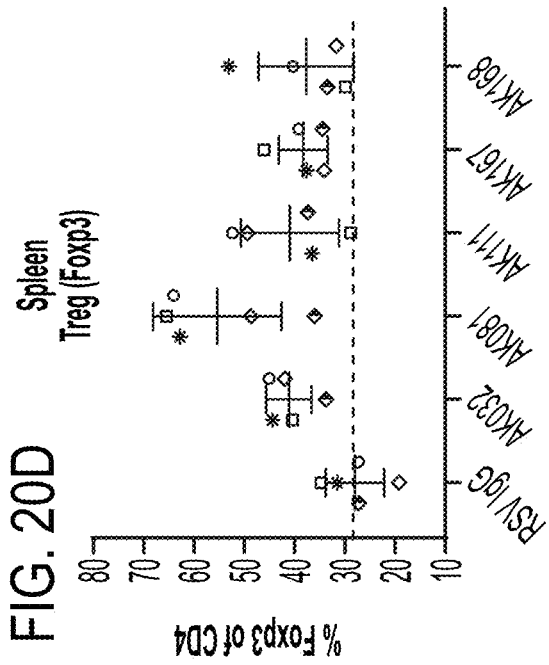
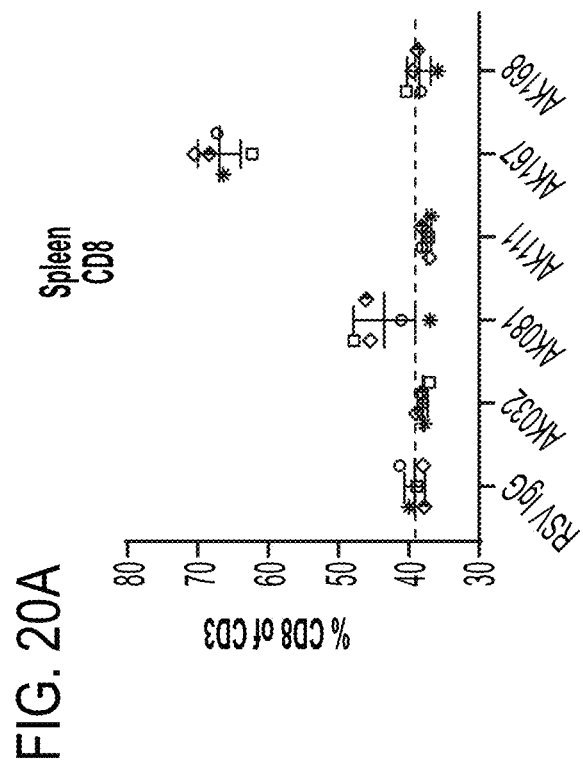
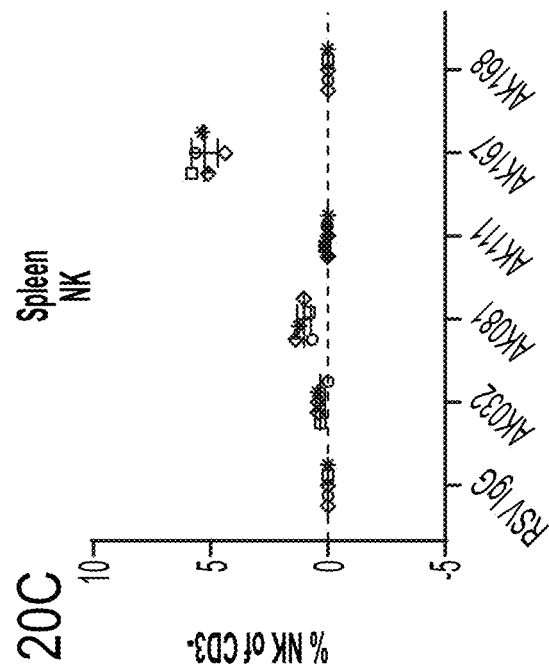

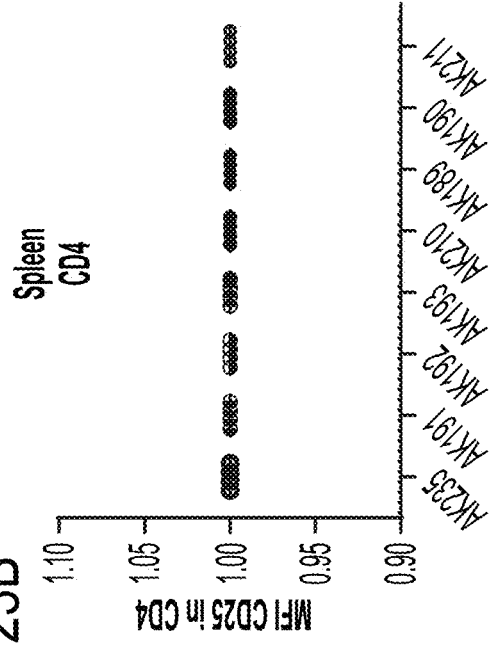
FIG. 23B
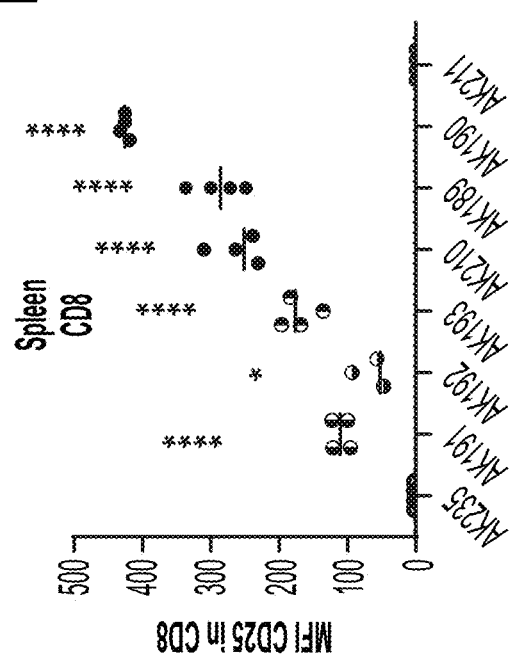
FIG. 23A
FIG. 23C

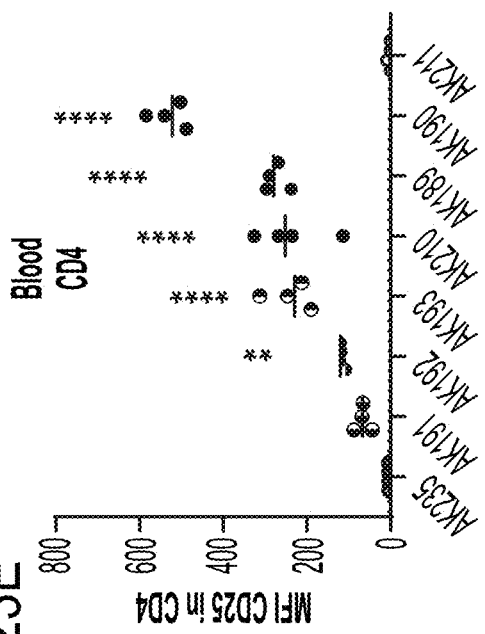
FIG. 23E
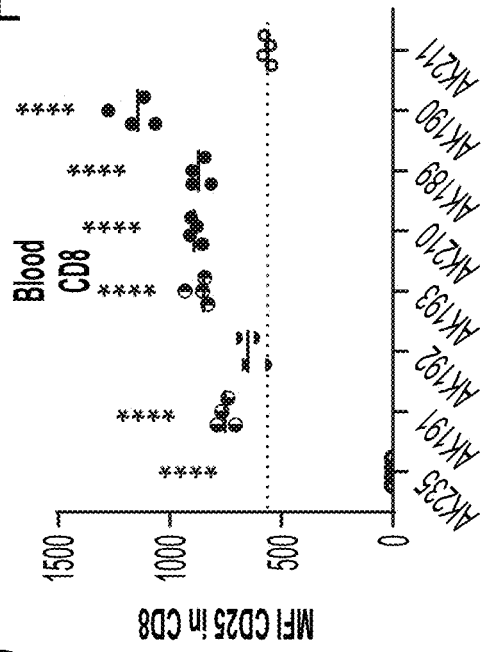
FIG. 23D
FIG. 23F

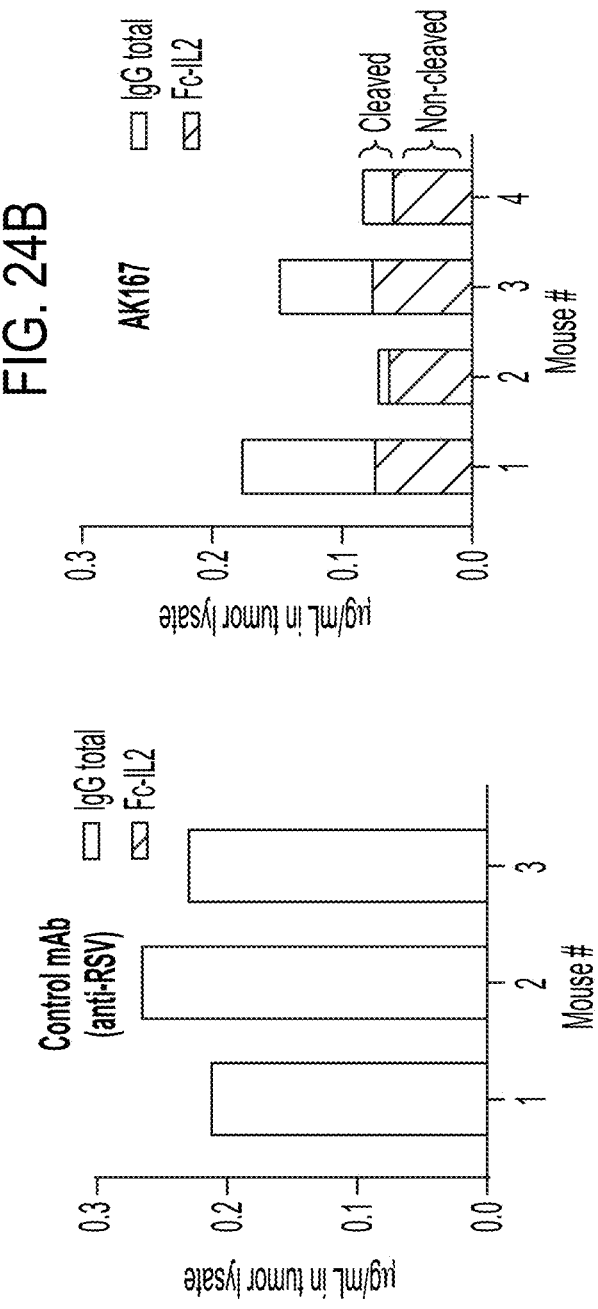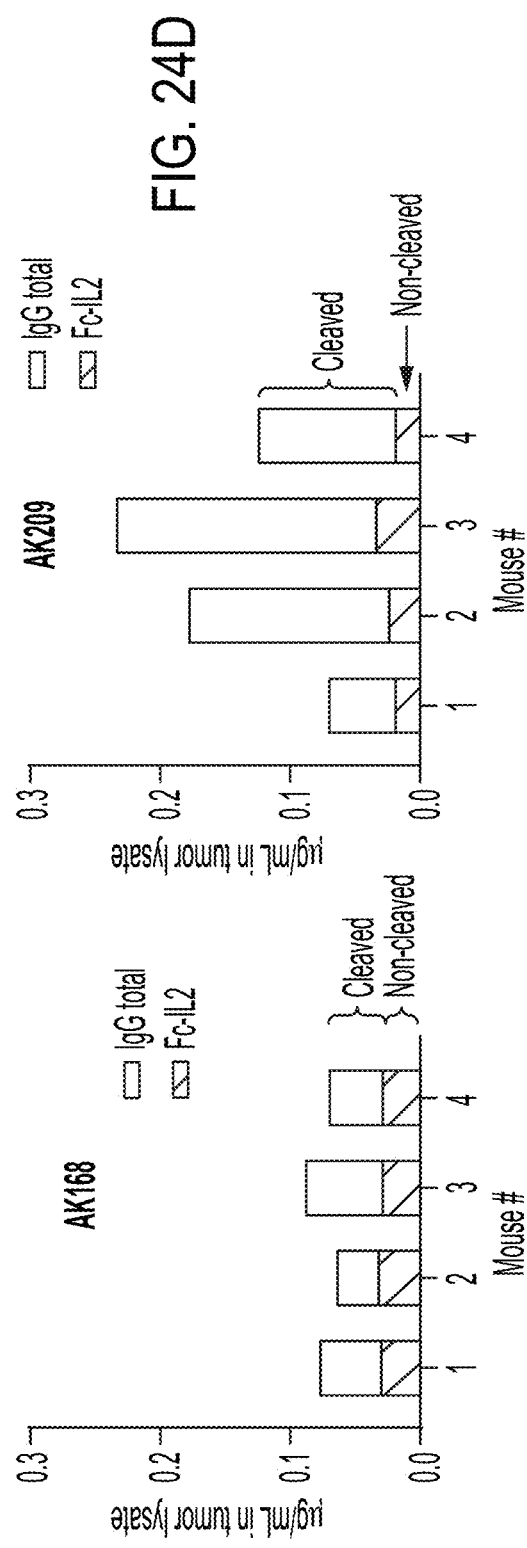
FIG. 24A FIG. 24B FIG. 24C FIG. 24D

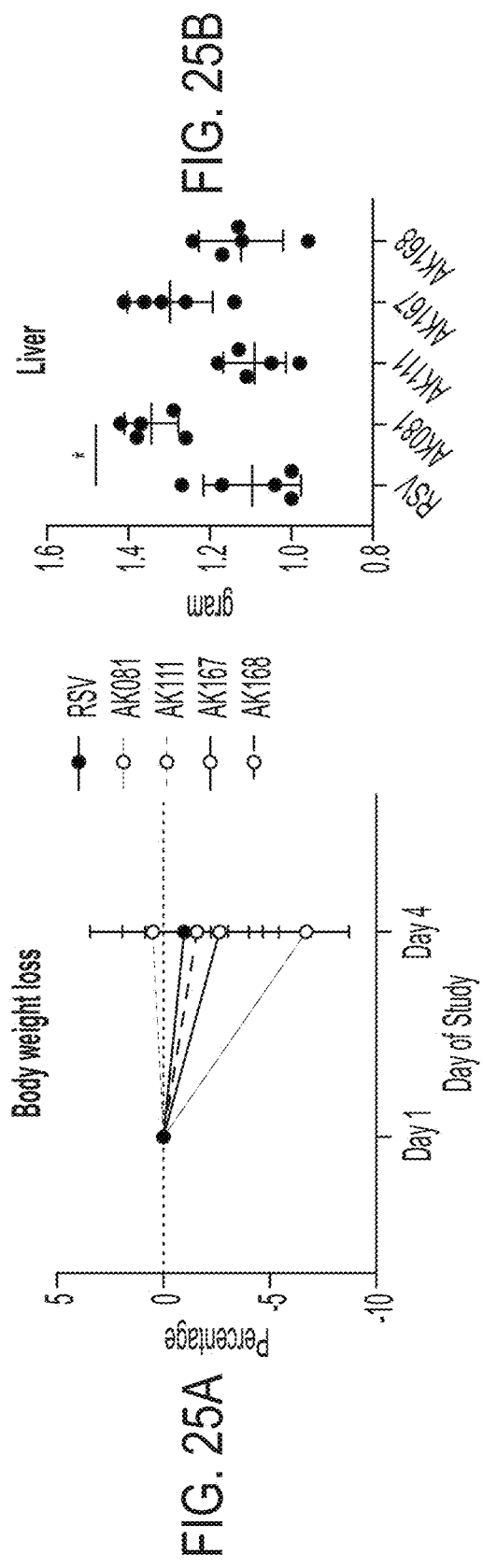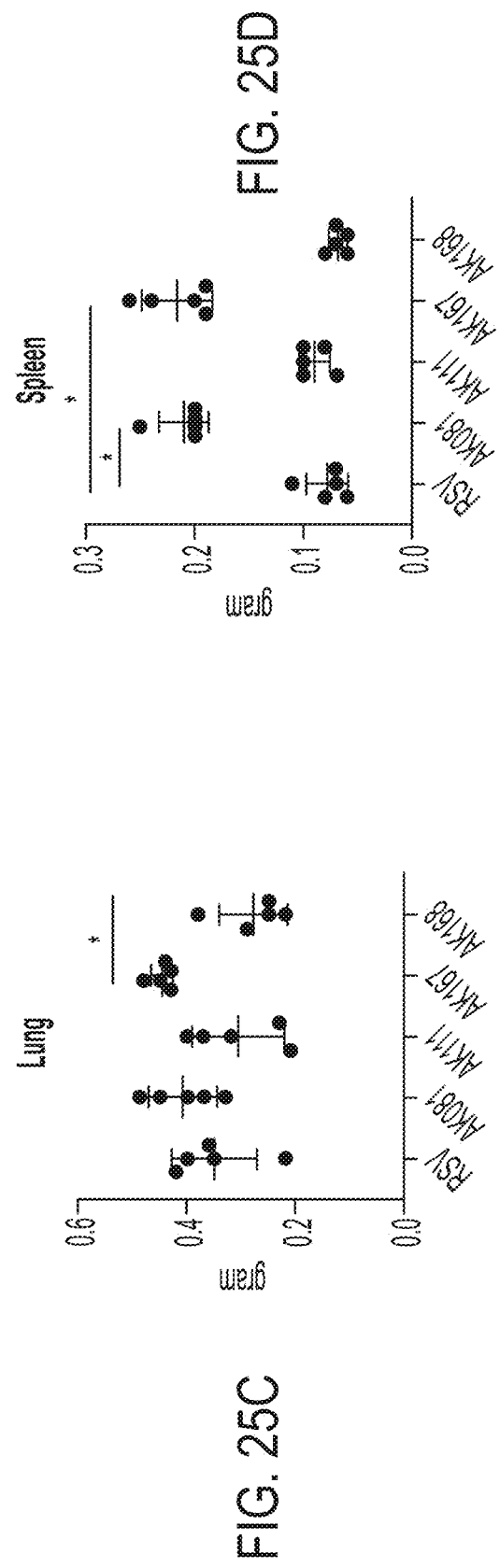
FIG. 25A FIG. 25B FIG. 25C FIG. 25D

-○- AK211
-□- AK209
-▽- AK471
-◇- AK235

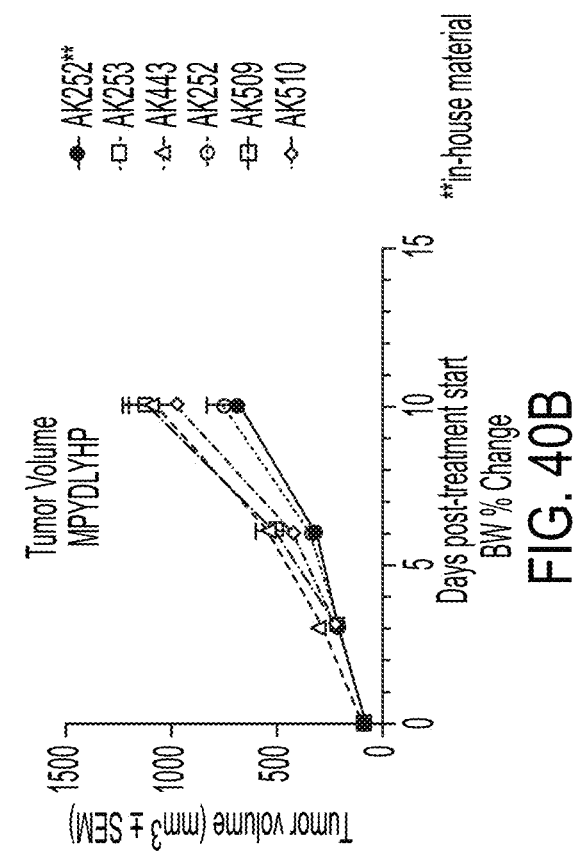
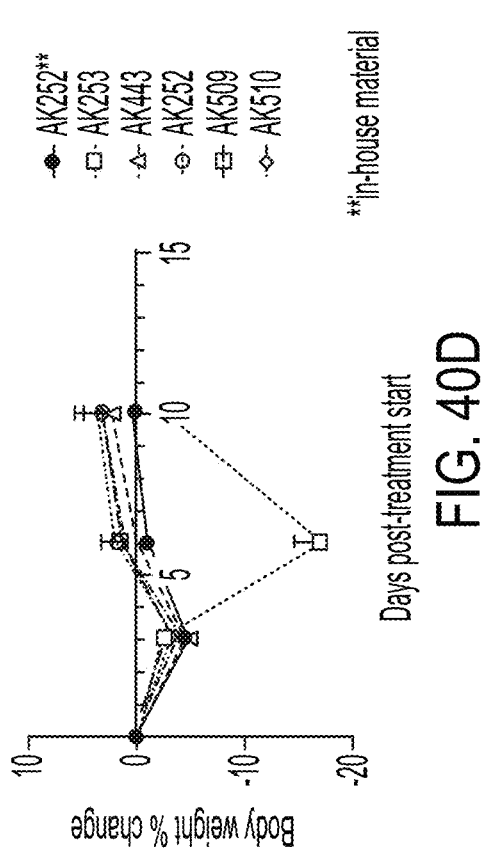
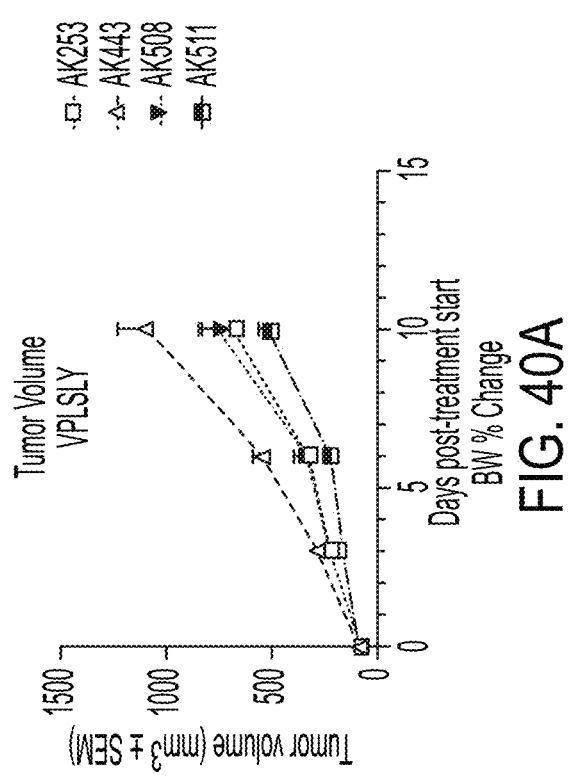
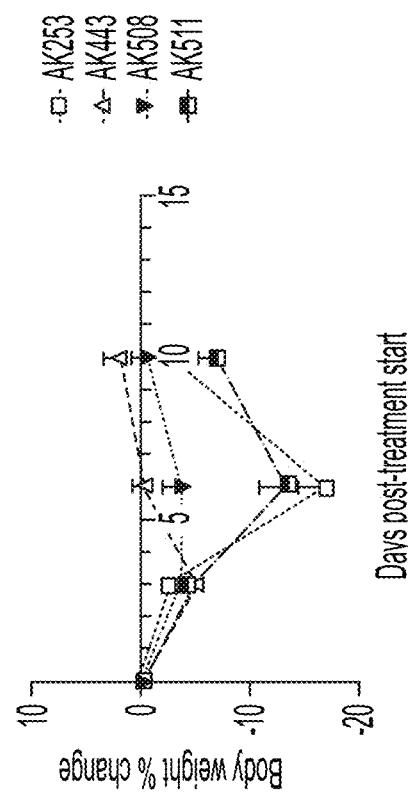

Construct cleaved for 36 hr

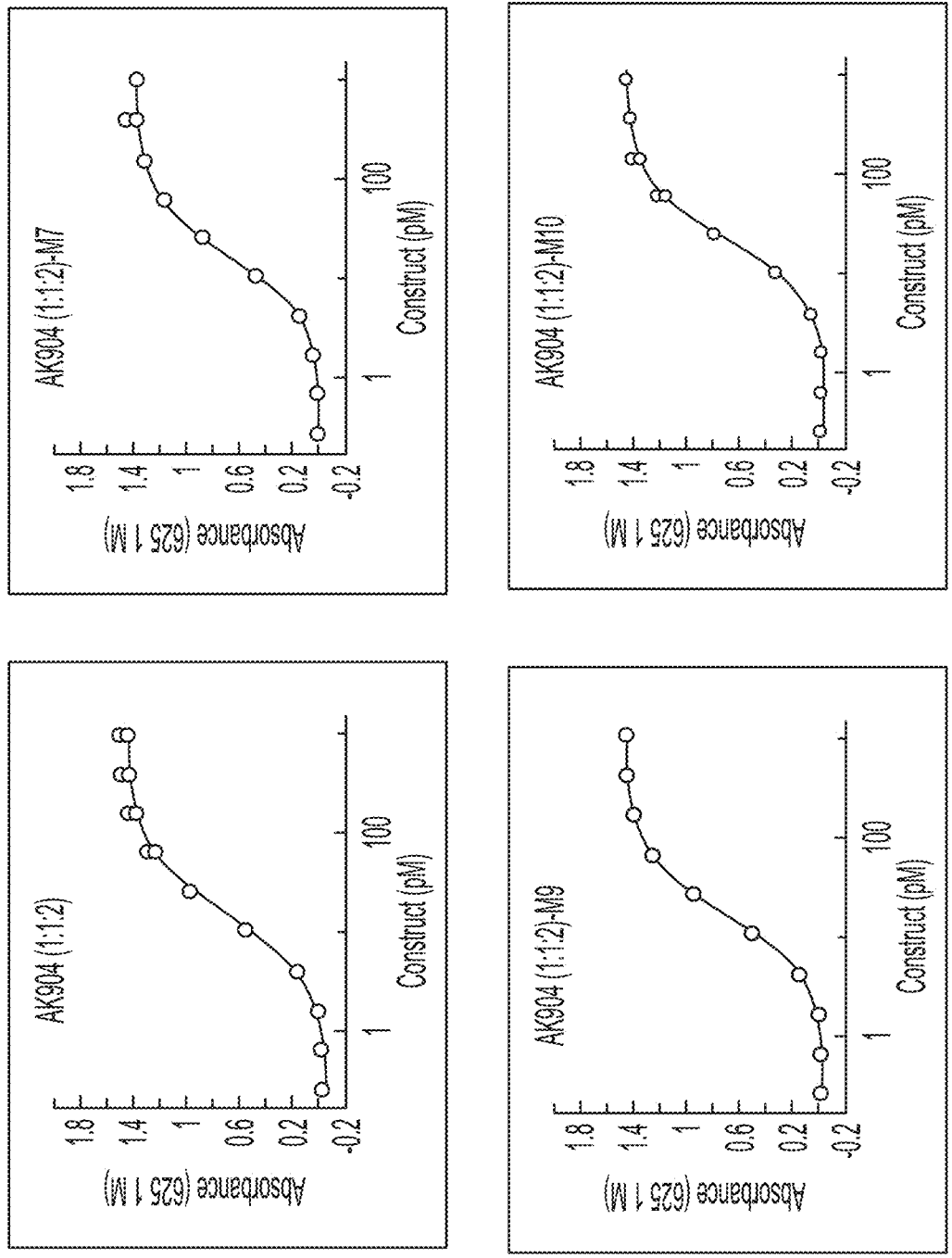
FIG. 45A (AK904)

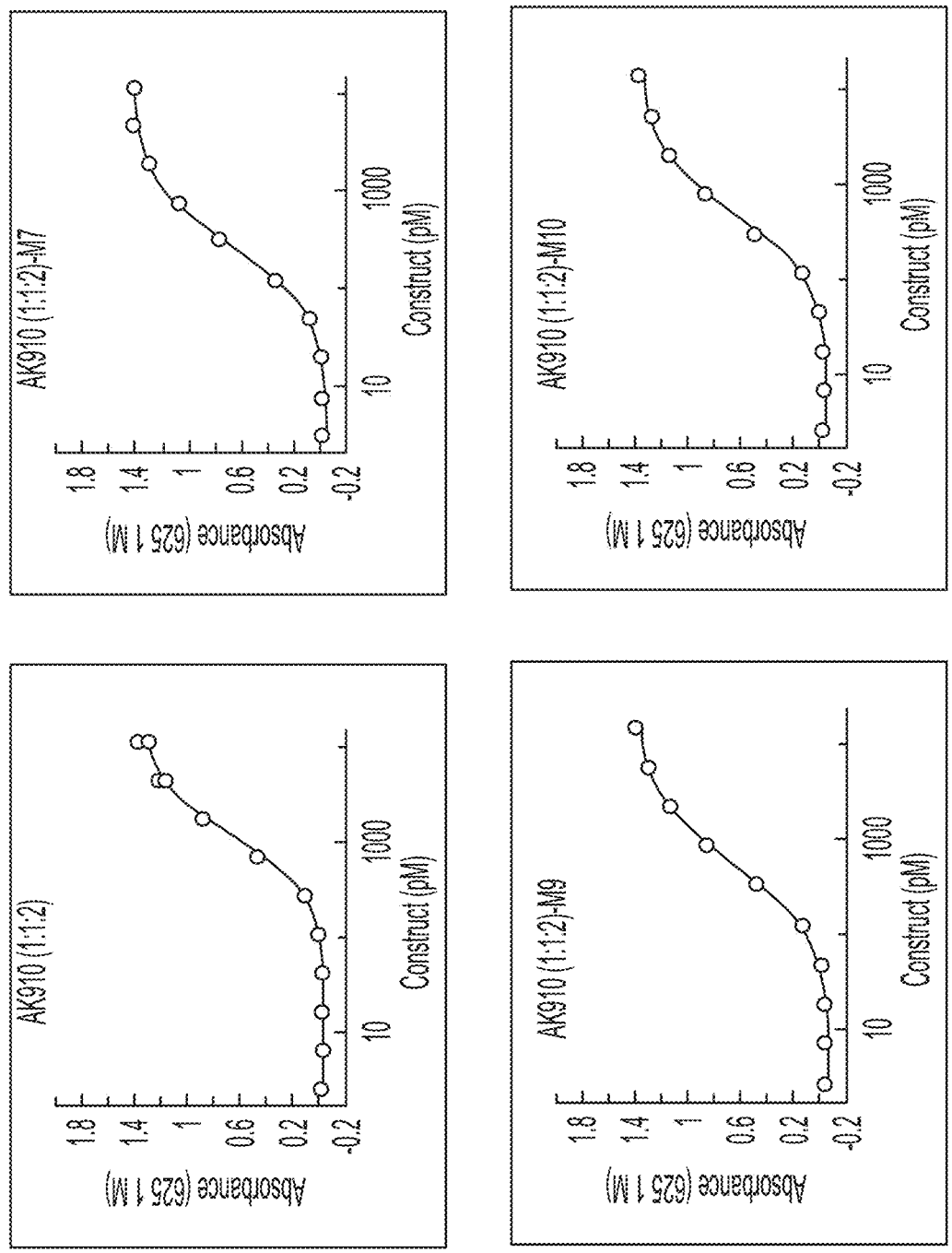
FIG. 45B (AK910)

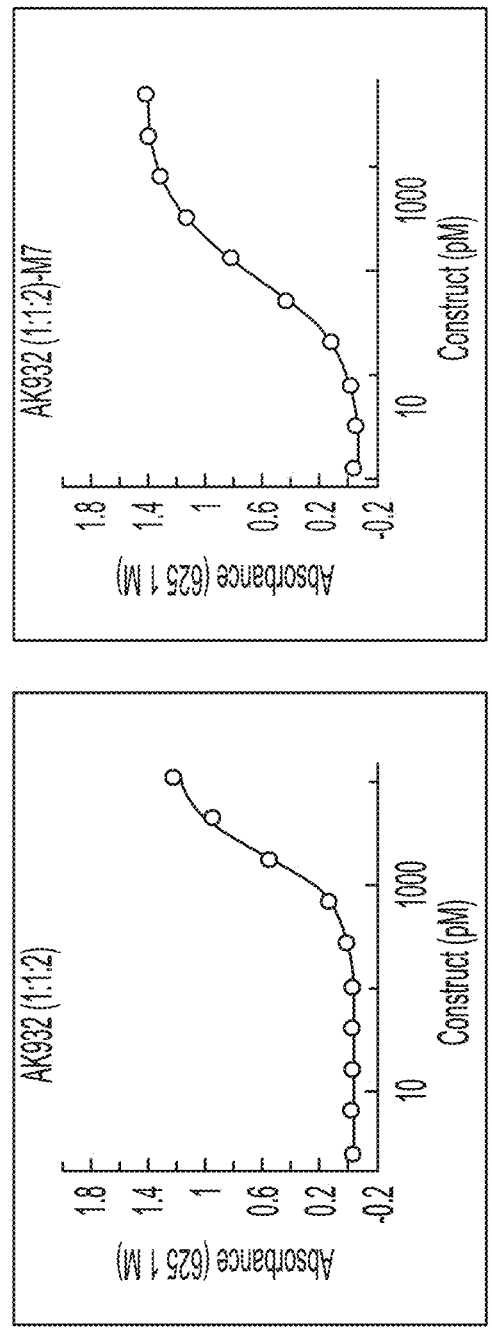
FIG. 45C (AK932)

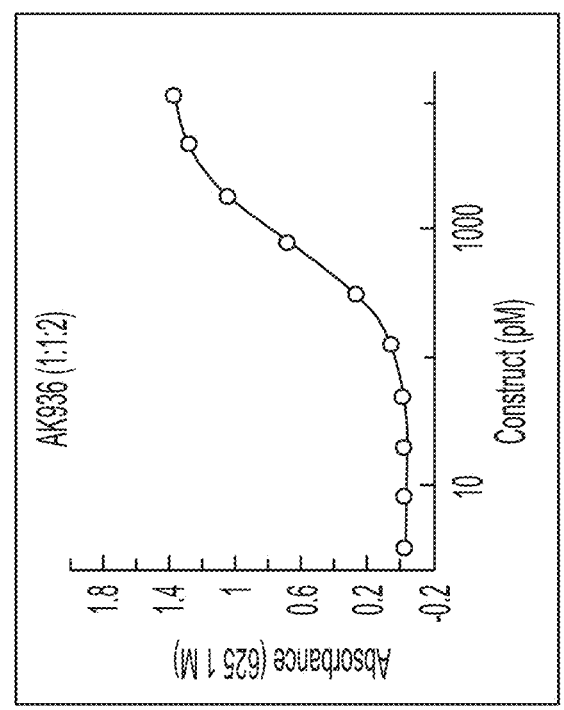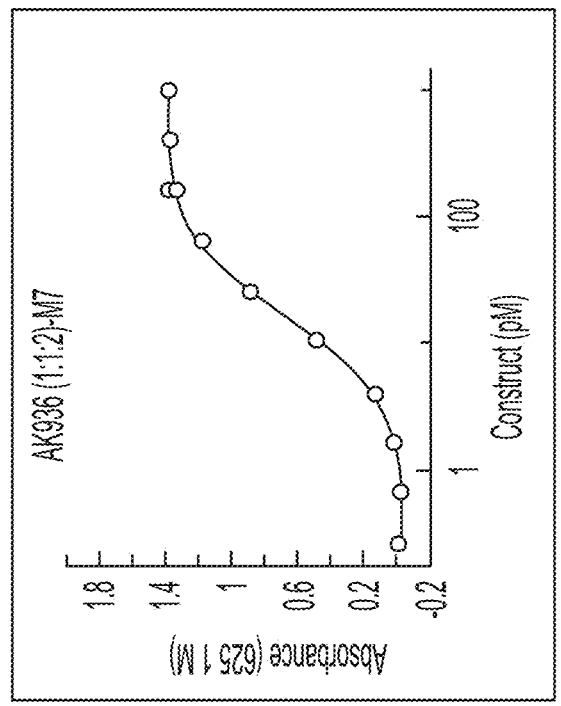
FIG. 45D (AK936)

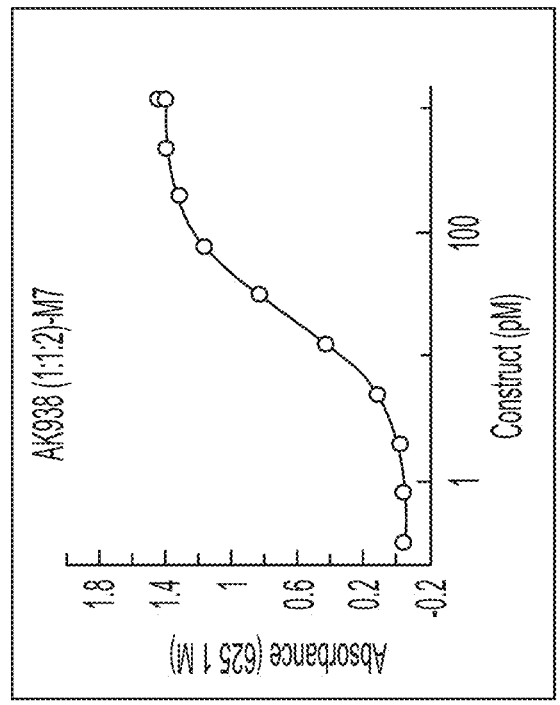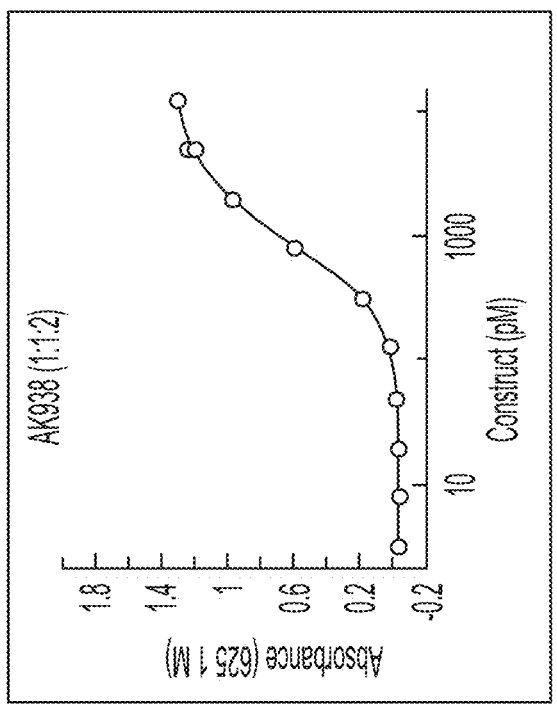
FIG. 45E (AK938)

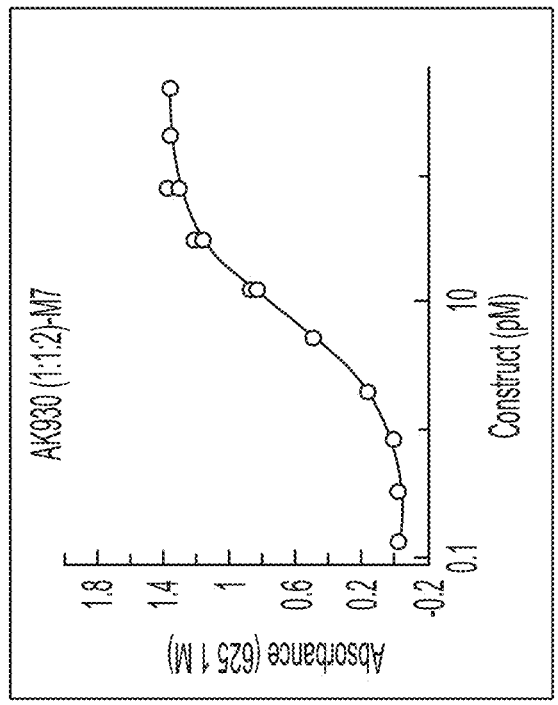
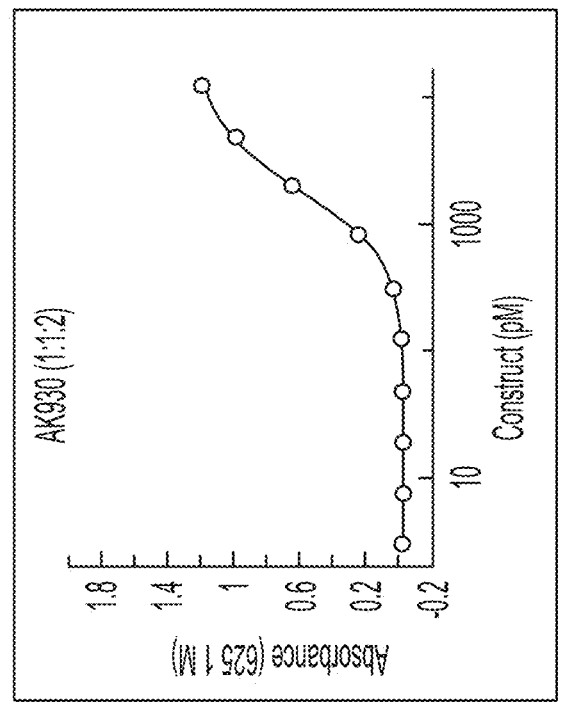
FIG. 45F (AK930)

| Construct | EC50 (pM) | Fold-Aklusion |
|---|---|---|
| rhIL-12 | 12.55 | N/A |
| AK386 | 1294 | 103.1 |
| AK386 + MMP 7 | 21.76 | 1.7 |

| Construct | EC50 (pM) | Fold-Aklusion |
|---|---|---|
| rhIL-12 | 12.55 | N/A |
| AK667 | 5412 | 431.2 |
| AK667 + MMP 7 | 49.24 | 3.9 |
| AK667 + MMP 9 | 67.88 | 5.4 |
| AK667 + MMP 10 | 52.29 | 4.2 |

FIG. 52C
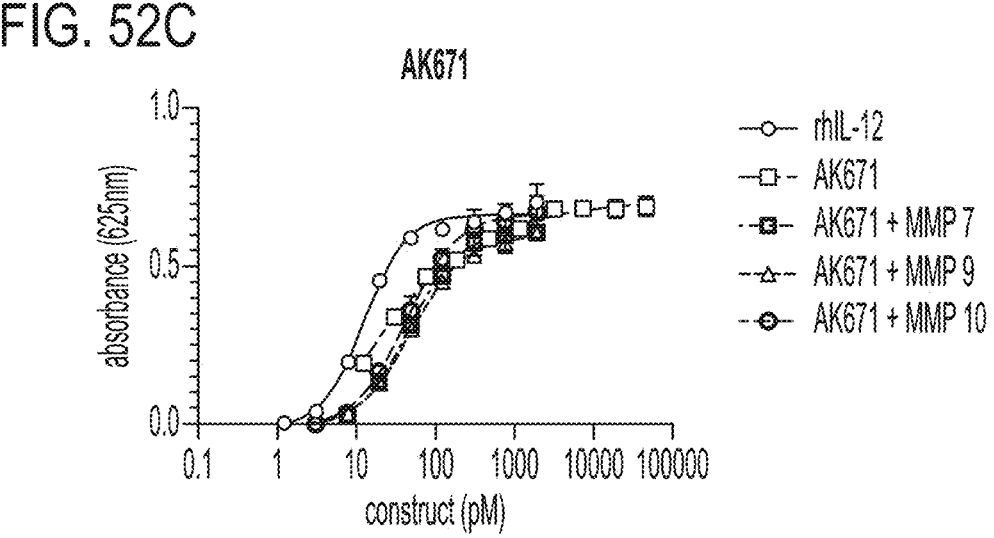
| Construct | EC50 (pM) | Fold-Aklusion |
|---|---|---|
| rhIL-12 | 12.55 | N/A |
| AK671 | 1.36* | 0.1* |
| AK671 + MMP 7 | 46.04 | 3.7 |
| AK671 + MMP 9 | 48.42 | 3.9 |
| AK671 + MMP 10 | 42.47 | 3.4 |
FIG. 52D (AK918)
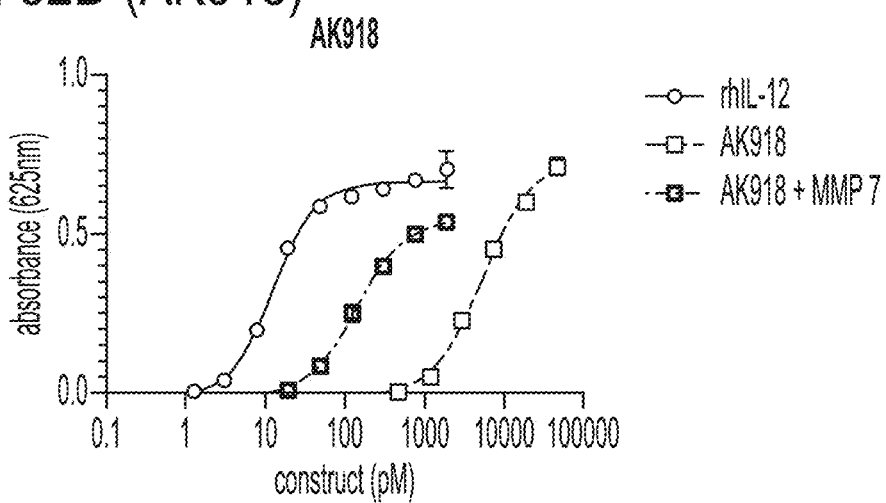
| Construct | EC50 (pM) | Fold-Aklusion |
|---|---|---|
| rhIL-12 | 12.55 | N/A |
| AK918 | 5372 | 428.0 |
| AK918 + MMP 7 | 141 | 11.2 |

FIG. 52E (AK919)
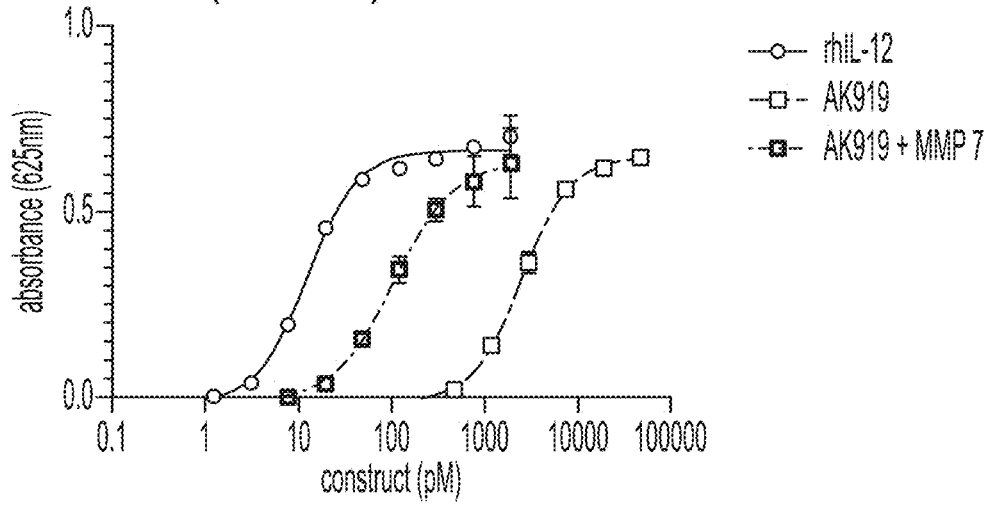
| Construct | EC50 (pM) | Fold-Aklusion |
|---|---|---|
| rhIL-12 | 12.55 | N/A |
| AK919 | 2506 | 199.7 |
| AK919 + MMP 7 | 106.5 | 8.5 |
FIG. 52F
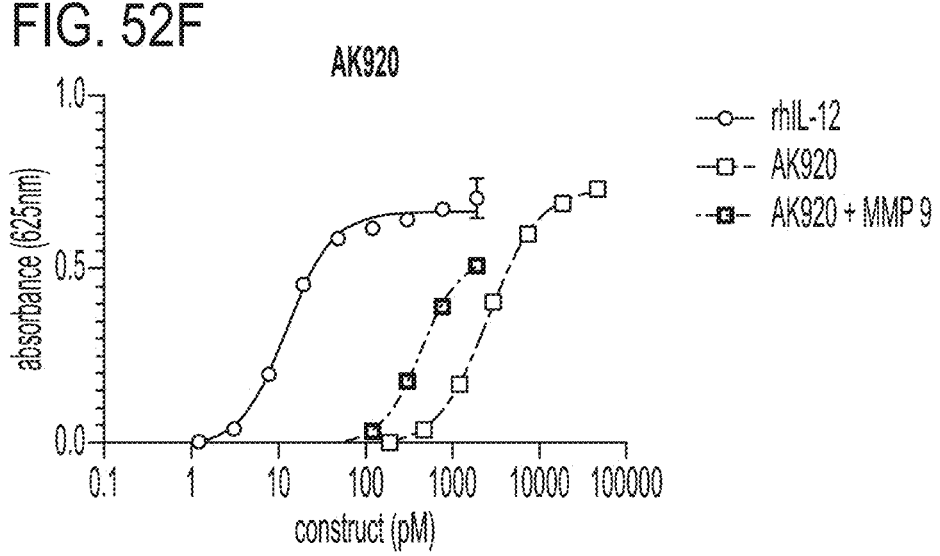
| Construct | EC50 (pM) | Fold-Aklusion |
|---|---|---|
| rhIL-12 | 12.55 | N/A |
| AK920 | 2600 | 207.2 |
| AK920 + MMP 9 | 442.9 | 35.3 |

| Construct | EC50 (pM) | Fold-Aklusion |
|---|---|---|
| rhIL-12 | 11.69 | N/A |
| AK671 | 20.12 | N/A |
| AK386 null | 580.8 | 28.9 |
| AK386 + MMP 7 | 16.09 | 0.8 |
| AK386 + MMP 10 | 71.95 | 3.6 |

| Construct | EC50 (pM) | Fold-Aklusion |
|---|---|---|
| rhIL-12 | 11.69 | |
| AK671 | 20.12 | |
| AK922 null | 1102 | 54.8 |
| AK922 + MMP 7 | 27.5 | 1.4 |

| Construct | EC50 (pM) | Fold-Aklusion |
|---|---|---|
| rhIL-12 | 11.69 | |
| AK671 | 20.12 | |
| AK923 null | 1393 | 69.2 |
| AK923 + MMP 7 | 23.84 | 1.2 |

| Construct | EC50 (pM) | Fold-Aklusion |
|---|---|---|
| rhIL-12 | 11.69 | |
| AK671 | 20.12 | |
| AK924 null | 876.2 | 43.5 |
| AK924 + MMP 10 | 151 | 7.5 |

| Construct | EC50 (pM) | Fold-Aklusion |
|---|---|---|
| rhIL-12 | 11.69 | |
| AK671 | 20.12 | |
| AK925 null | 1055 | 52.4 |
| AK925 + MMP 10 | 149.5 | 7.4 |

| | | |
|---|---|---|
| AK443<br>(VPLSLY; SEQ ID NO:28)<br><br>IL-2 dead | | |
| AK211 | | |
| AK235<br>(VPLSLY; SEQ ID NO: 28) | | |
| AK209<br>(VPLSLY; SEQ ID NO: 28) | | |
| AK471<br>(VPLSLY; SEQ ID NO: 28)<br><br>FcRn mutant | | |

FIG. 68

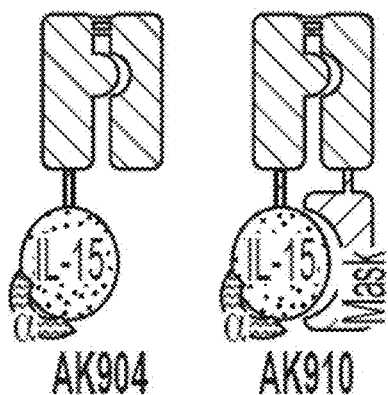
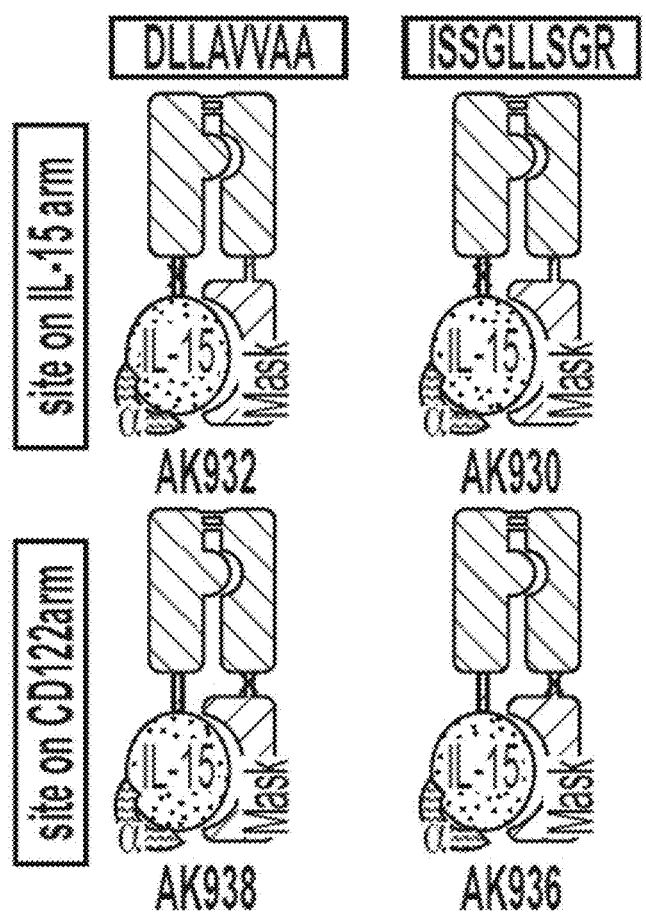
FIG. 69

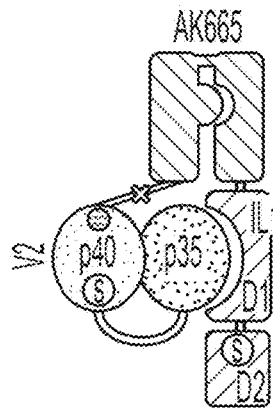
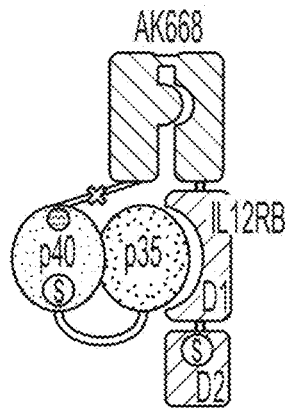
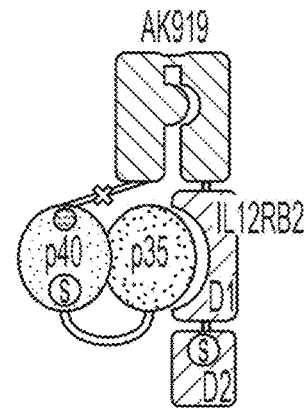
FIG. 71G  FIG. 71H  FIG. 71I
(SEQ ID NO: 27)  (SEQ ID NO: 249)
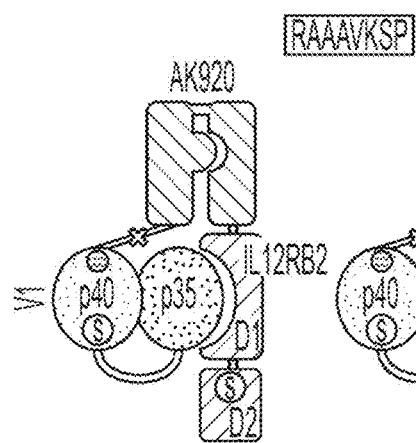
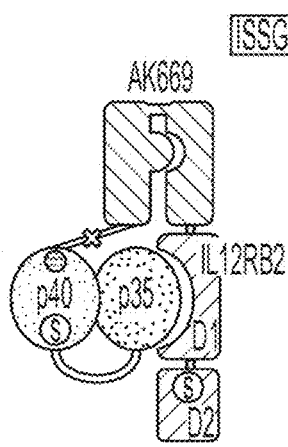
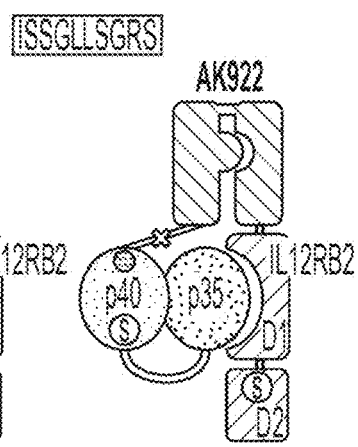
FIG. 71J  FIG. 71K  FIG. 71L  FIG. 71M
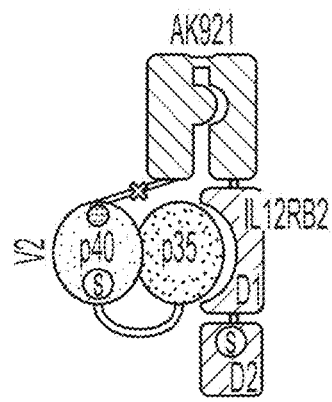
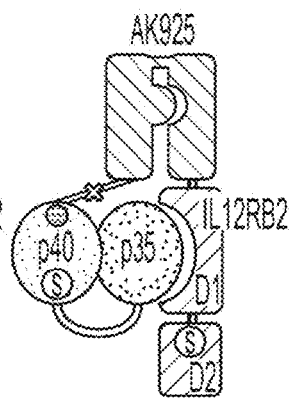
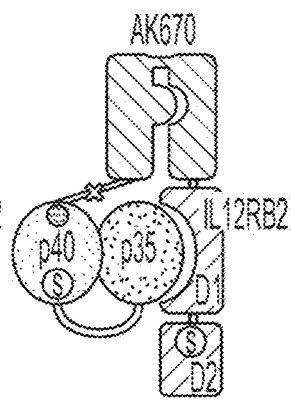
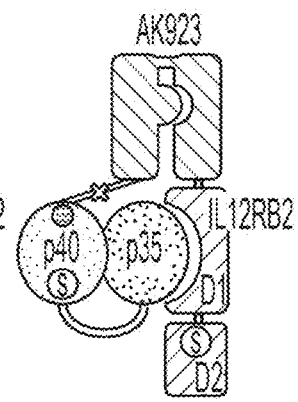
FIG. 71N  FIG. 71O  FIG. 71P  FIG. 71Q

AK904

AK910

TUMOR-SPECIFIC CLEAVABLE LINKERS

CROSS-REFERENCE TO RELATED APPLICATIONS

This application claims the priority benefit of U.S. Provisional Application Ser. No. 63/118,585, filed Nov. 25, 2020; and 63/253,090, filed Oct. 6, 2021; each of which is incorporated herein by reference in its entirety.

SUBMISSION OF SEQUENCE LISTING ON ASCII TEXT FILE

The content of the following submission on ASCII text file is incorporated herein by reference in its entirety: a computer readable form (CRF) of the Sequence Listing (file name: 73776-20030_00_SL.TXT, created on Apr. 12, 2022 is 1,047,718 bytes in size).

FIELD

This invention relates to tumor-specific cleavable linkers and their use in drugs and prodrugs for delivering therapeutics to a tumor cell environment. This invention also relates to cleavage products of said drugs and prodrugs, and methods related to the use of the same.

BACKGROUND

Cancer is the second leading cause of death in the United States, accounting for more deaths than the next five leading causes (chronic respiratory disease, stroke, accidents, Alzheimer's disease and diabetes). While great strides have been made especially with targeted therapies, there remains a great deal of work to do in this space. Immunotherapy and a branch of this field, immuno-oncology, is creating viable and exciting therapeutic options for treating malignancies. Specifically, it is now recognized that one hallmark of cancer is immune evasion and significant efforts have identified targets and developed therapies to these targets to reactivate the immune system to recognize and treat cancer.

Cytokine therapy is an effective strategy for stimulating the immune system to induce anti-tumor cytotoxicity. In particular, aldesleukin, a recombinant form of interleukin-2 (IL-2), has been approved by the FDA for the treatment of metastatic renal cell carcinoma and melanoma. Unfortunately, cytokines that are administered to patients generally have a very short half-life, thereby requiring frequent dosing. For instance, the product label of aldesleukin, marketed under the brand name PROLEUKIN, states that the drug was shown to have a half-life of 85 minutes in patients who received a 5-minute intravenous (IV) infusion. In addition, administration of high doses of cytokine can cause adverse health outcomes, such as vascular leakage, through systemic immune activation. These findings illustrate the need for developing therapeutics, such as cytokine therapeutics, that effectively target tumors without the side effects associated with systemic immune activation.

Prodrugs in which a cytokine therapeutic is masked by a masking moiety and in which the therapeutic is only active after cleavage of the masking moiety in the tumor cell environment are one way envisaged for addressing this need.

SUMMARY

This invention provides novel tumor-specific proteolytically cleavable peptide linkers comprising tumor-specific proteolytically cleavable peptides and their use in polypeptide drug constructs for delivering a therapeutic moiety to a tumor cell environment. The part of the construct other than the therapeutic moiety can be considered as a carrier moiety.

The tumor-specific proteolytically cleavable peptide acts as a substrate for protease(s) present in the tumor cell environment. The proteolytically cleavable peptide linker is positioned within the polypeptide drug construct so that the linker cleaves by protease action in the tumor cell environment, and the polypeptide drug construct separates to form cleavage products, one of which will comprise the therapeutic moiety. This invention also relates to cleavage products of said drug constructs, and methods related to the use of the same.

Provided herein is a polypeptide drug construct comprising (i) a therapeutic moiety; (ii) a carrier moiety and (iii) a proteolytically cleavable peptide linker comprising a tumor-specific proteolytically cleavable peptide having an amino acid sequence DLLAVVAAS (SEQ ID NO: 248) or ISSGLLSGRS (SEQ ID NO: 249).

In some embodiments, the proteolytically cleavable peptide (CP) is flanked on both sides by a spacer domain (SD1 and SD2) as shown in formula:

SD1-CP-SD2.

In some embodiments, the spacer domains are rich in amino acid residues G, S and P.

In some embodiments, the proteolytically cleavable peptide linker is from 10 to 25 amino acids in length.

In some embodiments, the spacer domains only include amino acid residue types selected from the group consisting of G, S and P.

In some embodiments, the first spacer domain (SD1) is between 3 and 6 amino acids in length.

In some embodiments, the second spacer domain (SD2) is between 3 and 6 amino acids in length.

In some embodiments, SD2 comprises the amino acid sequence SGP.

In some embodiments, SD2 has the amino acid sequence SGP.

In some embodiments, the proteolytically cleavable peptide linker comprises sequence GGPSDLLAVVAASSGP (SEQ ID NO: 245).

In some embodiments, the proteolytically cleavable peptide linker comprises sequence GSGPSDLLAVVAASSGP (SEQ ID NO: 246).

In some embodiments, the proteolytically cleavable peptide linker comprises sequence GSSGGPDLLAVVAASSGP (SEQ ID NO: 247).

In some embodiments, the proteolytically cleavable peptide linker comprises sequence GSPDLLAVVAASSGP (SEQ ID NO: 242).

In some embodiments, the proteolytically cleavable peptide linker comprises sequence GSPGDLLAVVAASSGP (SEQ ID NO: 243).

In some embodiments, the proteolytically cleavable peptide linker comprises sequence GSGSPSDLLAVVAASSGP (SEQ ID NO: 244).

In some embodiments, the proteolytically cleavable linker comprises sequence GGSSGGSPISSGLLSGRSSGPGSGS (SEQ ID NO: 112).

In some embodiments, the proteolytically cleavable linker comprises sequence GPPSGSSPISSGLLSGRSSGGG (SEQ ID NO: 113).

In some embodiments, the proteolytically cleavable linker comprises sequence GGSGGSISSGLLSGRSSGP (SEQ ID NO: 114).

In some embodiments, the proteolytically cleavable linker comprises sequence GGSGGSGGSISSGLLSGRSSGP (SEQ ID NO: 115).

In some embodiments, the proteolytically proteolytically cleavable peptide linker is covalently bonded directly to the therapeutic moiety.

In some embodiments, the proteolytically cleavable peptide linker is located within the drug construct between the therapeutic moiety and the carrier moiety.

In some embodiments, the proteolytically cleavable peptide linker is located within the carrier moiety.

In some embodiments, the polypeptide drug construct comprises a single polypeptide chain. This means that the therapeutic moiety, the carrier moiety and the proteolytically cleavable peptide linker are present in the same polypeptide chain.

In some embodiments, the polypeptide drug construct comprises more than one polypeptide chain. In some embodiments, the proteolytically cleavable peptide linker is present in the same polypeptide chain as the therapeutic moiety. In some embodiments, the proteolytically cleavable peptide linker is present in a different polypeptide chain to the therapeutic moiety.

In some embodiments, the polypeptide drug construct is a prodrug. In some embodiments, where the polypeptide drug construct is a prodrug, the remainder of the molecule (away from which the therapeutic moiety separates after cleavage of the proteolytically cleavable peptide linker) comprises a masking moiety, which inhibits the biological activity of the therapeutic moiety in the prodrug such that the therapeutic moiety is biologically active only after cleavage of the proteolytically cleavable peptide linker in the tumor cell environment In some embodiments, the masking moiety is present in the same polypeptide chain as the therapeutic moiety. In some embodiments, the masking moiety is present in a different polypeptide chain to the therapeutic moiety.

In some embodiments, the masking moiety is present in the same polypeptide chain as the therapeutic moiety.

In some embodiments, the masking moiety is present in a first polypeptide chain and the therapeutic moiety is present in a second polypeptide chain.

In some embodiments, the drug construct comprises a half-life extension moiety.

In some embodiments, the half-life extension moiety comprises an antibody or fragment thereof.

In some embodiments, the half-life extension moiety comprises first and second half-life extension moieties.

In some embodiments, the prodrug is a cytokine prodrug where the therapeutic moiety is a cytokine moiety.

In some embodiments, the masking moiety comprises a domain of the extracellular domain of the cytokine receptor.

A cytokine prodrug as described herein, where the therapeutic moiety is a cytokine moiety and the masking moiety comprises a domain of the extracellular domain of the cytokine receptor is referred to herein as a "masked cytokine".

Provided herein, in some embodiments, is a masked cytokine comprising a masking moiety in a first polypeptide chain and a cytokine moiety thereof in a second polypeptide chain. Such masked cytokines may be referred to as 'heterodimeric' masked cytokines.

In some embodiments, the masked cytokine comprises a protein heterodimer comprising:
 a) a first polypeptide chain comprising a masking moiety linked to a first half-life extension moiety via a first linker; and
 b) a second polypeptide chain comprising a cytokine moiety thereof linked to a second half-life extension moiety via a second linker, wherein the first half-life extension moiety is associated with the second half-life extension moiety, and wherein at least the first linker or the second linker is a proteolytically cleavable peptide linker comprising a proteolytically cleavable peptide (CP) consisting of the amino acid sequence DLLAVVAAS (SEQ ID NO: 248) or ISSGLLSGRS (SEQ ID NO: 249).

In some embodiments, in the first polypeptide chain, the first half life extension domain is linked to the amino terminus of the first linker and the carboxy terminus of the first linker is linked to the amino terminus of the masking moiety and, in the second polypeptide chain, the second half life extension domain is linked to the amino terminus of the second linker and the carboxy terminus of the second linker is linked to the amino terminus of the cytokine moiety thereof.

In some embodiments, the first polypeptide chain comprises:

N'HL1-L1-MM C' and the second polypeptide chain comprises:

N'HL2-L2-C C' where HL1 is the first half life extension domain, L1 is the first linker, MM is the masking moiety, HL2 is the second half life extension domain, L2 is the second linker, and C is the cytokine moiety, wherein the first half-life extension moiety is associated with the second half-life extension moiety, and wherein at least the first linker or the second linker is a proteolytically cleavable peptide linker comprising a proteolytically cleavable peptide (CP) consisting of the amino acid sequence DLLAVVAAS (SEQ ID NO: 248) or ISSGLLSGRS (SEQ ID NO: 249).

In some embodiments, the second linker is the proteolytically cleavable linker and the first linker is a non-cleavable linker. This arrangement is described herein as 'Structure A'.

In some embodiments, the first polypeptide chain comprises:

N'HL1-non-cleavable L1-MM C' and the second polypeptide chain comprises:

N'HL2-cleavable L2-C C'

In some embodiments, the first linker is the proteolytically cleavable linker and the second is a non-cleavable linker. This arrangement is described herein as 'Structure B'.

In some embodiments, the first polypeptide chain comprises:

N'HL1-cleavable L1-MM C' and the second polypeptide chain comprises:

N'HL2-non-cleavable L2-C C'

Provided herein, in some embodiments, is a masked cytokine comprising a masking moiety and a cytokine moiety thereof linked in a single polypeptide chain. In some embodiments, the masked cytokine comprises a polypeptide chain comprising formula:

N'HL-L2-C-L1-MM C' where HL is the half-life extension domain, L1 is the first linker, MM is the masking moiety, L2 is the second linker, and C is the cytokine moiety, wherein at least the first linker comprises a proteolytically cleavable peptide linker comprising a proteolytically cleavable peptide (CP) consisting of the amino acid sequence DLLAVVAAS (SEQ ID NO: 248) or ISSGLLSGRS (SEQ ID NO: 249). The proteolytically cleavable peptide linker may be as described anywhere herein. In some embodiments, the first linker is a proteolytically cleavable peptide linker comprising a proteolytically cleavable peptide (CP) consisting of the amino acid sequence DLLAVVAAS (SEQ ID NO: 248). In some embodiments, the first linker is a proteolytically cleavable peptide linker comprising a proteolytically cleavable peptide (CP) consisting of the amino acid sequence ISSGLLSGRS (SEQ ID NO: 249). In some embodiments, the first linker is a proteolytically cleavable peptide linker and the second linker is non-cleavable. The non-cleavable linker may be as described anywhere herein.

In some embodiments, the masked cytokine comprises a polypeptide chain comprising formula:

N'HL-L2-MM-L1-C C' where HL is the half-life extension domain, L1 is the first linker, MM is the masking moiety, L2 is the second linker, and C is the cytokine moiety thereof, wherein at least the first linker comprises a proteolytically cleavable peptide linker comprising a proteolytically cleavable peptide (CP) consisting of the amino acid sequence DLLAVVAAS (SEQ ID NO: 248) or ISSGLLSGRS (SEQ ID NO: 249). The proteolytically cleavable peptide linker may be as described anywhere herein. In some embodiments, the first linker is a proteolytically cleavable peptide linker comprising a proteolytically cleavable peptide (CP) consisting of the amino acid sequence DLLAVVAAS (SEQ ID NO: 248). In some embodiments, the first linker is a proteolytically cleavable peptide linker comprising a proteolytically cleavable peptide (CP) consisting of the amino acid sequence ISSGLLSGRS (SEQ ID NO: 249). In some embodiments, the first linker is a proteolytically cleavable peptide linker and the second linker is non-cleavable. The non-cleavable linker may be as described anywhere herein.

In some embodiments, the non-cleavable linker is between 3 and 25 amino acids in length.

In some embodiments, wherein the non-cleavable linker is rich in amino acid residues G, S and P.

In some embodiments, the non-cleavable linker comprises an amino acid sequence of SEQ ID NO: 14.

In some embodiments, the non-cleavable linker comprises an amino acid sequence of SEQ ID NO: 23.

In some embodiments, the half-life extension domain comprises a first half life extension domain and a second half life extension domain.

In some embodiments, the first half-life extension domain comprises a first Fc domain or a fragment thereof and the second Fc domain comprises an Fc domain or a fragment thereof.

In some embodiments, the first Fc domain comprises a CH3 domain or a fragment thereof and the second Fc domain comprises a CH3 domain or a fragment thereof.

In some embodiments, the first and second half-life extension domains are each an IgG1 Fc domain or fragment thereof.

In some embodiments, the first and/or second Fc domains each contain one or more modifications that promote the non-covalent association of the first and the second half-life extension domains.

In some embodiments, the first half-life extension domain comprises an IgG1 Fc domain or fragment thereof including the mutations Y349C; T366S; L38A; and Y407V to form a 'hole' in the first half-life extension domain and the second half-life extension domain comprises an IgG1 Fc domain or fragment thereof including the mutations S354C and T366W to form the 'knob' in the second half-life extension domain, numbered according to the Kabat EU numbering system.

In some embodiments, the first and second half-life extension domains are each an IgG1 Fc domain or fragment thereof and each comprise an amino substitution at position 297, numbered according to the Kabat EU numbering system.

In some embodiments, the first and second half-life extension domains are each an IgG1 Fc domain or fragment thereof and each comprise the amino substitution N297A, numbered according to the Kabat EU numbering system.

In some embodiments, the first and second half-life extension domains are each an IgG1 Fc domain or fragment thereof and each comprise an amino substitution at position 253, numbered according to the Kabat EU numbering system.

In some embodiments, the first and second half-life extension domains are each an IgG1 Fc domain or fragment thereof and each comprise the amino substitution I253A, numbered according to the Kabat EU numbering system.

In some embodiments, the first half-life extension domain comprises the amino acid sequence of SEQ ID NO: 9, and the second half-life extension domain thereof comprises the amino acid sequence of SEQ ID NO: 12.

In some embodiments, the first half-life extension domain comprises the amino acid sequence of SEQ ID NO: 10 and the second half-life extension domain thereof comprises the amino acid sequence of SEQ ID NO: 13.

In some embodiments, the half life extension domain (HL) comprises an Fc region of an antibody (i.e. the C-terminal region of an immunoglobulin heavy chain) or a fragment thereof comprising dimerized Fc domains (HL1-HL2). Although the boundaries of the Fc region of an immunoglobulin heavy chain might vary, the human IgG heavy-chain Fc region is usually defined to stretch from an amino acid residue at position Cys226, or from Pro230, to the carboxyl-terminus thereof. In some embodiments, the dimerized Fc domains of an antibody (HL1-HL2) comprises a first half life extension domain and a second half life extension domain as described anywhere herein, where the first half-life extension moiety comprises a first Fc domain or a fragment thereof and the second half-life extension moiety comprises a second Fc domain or a fragment thereof. In some embodiments, HL2 is a component of the polypeptide chain and HL1 is dimerized to HL2.

In some embodiments, the first and second half-life extension moieties are each an IgG1 Fc domain or fragment thereof. In some embodiments, the first half-life extension moiety comprises an IgG1 Fc domain or fragment thereof including the mutation I253A and the second half-life extension moiety comprises an IgG1 Fc domain or fragment thereof including the mutation I253A. In some embodiments, the first and second half-life extension moieties are derived from the sequence for human IgG1 Immunoglobulin heavy constant gamma 1 having SEQ ID NO: 6 (the 'parent sequence'), such that the first and second half-life extension moieties each comprise SEQ ID NO: 7 or fragment thereof, with one or more amino acid modifications. In some embodiments, the first and second half-life extension moieties comprise SEQ ID NO: 7 with amino substitutions to promote association of the first and second half-life extension moieties according to the 'knob into holes' approach. In some embodiments, the sequence SEQ ID NO: 7 contains mutations Y349C; T366S; L38A; and Y407V (numbered according to the Kabat EU numbering system) to form the 'hole' in the first half-life extension moiety and mutations S354C and T366W (numbered according to the Kabat EU numbering system) to form the 'knob' in the second half-life extension moiety. In some embodiments, the first and second half-life extension moieties each further comprise amino substitution N297A, numbered according to the Kabat EU numbering system. In some embodiments, the first and second half-life extension moieties each further comprise the amino substitution I253A, numbered according to the Kabat EU numbering system. In some embodiments, the first and second half-life extension moieties each further comprise both the amino substitutions N297A and I253A, numbered according to the Kabat EU numbering system. In some embodiments, the first half-life extension moiety comprises an amino acid sequence having about or at least about 85%, 86%, 87%, 88%, 89%, 90%, 91%, 92%, 93%, 94%, 95%, 96%, 97%, 98%, or 99% sequence identity to any one of the amino acid sequence of any one of SEQ ID NOs: 7, 8, 9 and 10. In some embodiments, the second half-life extension moiety comprises an amino acid sequence having about or at least about 85%, 86%, 87%, 88%, 89%, 90%, 91%, 92%, 93%, 94%, 95%, 96%, 97%, 98%, or 99% sequence identity to any one of the amino acid sequence of any one of SEQ ID NOs: 7, 11, 12 and 13.

In some embodiments, the cytokine moiety comprises a wild-type cytokine moiety or variant cytokine moiety.

In some embodiments, the cytokine moiety is an IL-2 cytokine moiety as described anywhere herein.

In some embodiments, the IL-2 cytokine moiety comprises a wild-type IL-2 cytokine moiety or variant thereof.

In some embodiments, the IL-2 cytokine moiety comprises an IL-2 cytokine or fragment thereof.

In some embodiments, the IL-2 cytokine or functional fragment thereof is modified compared to the sequence of a mature IL-2 having SEQ ID NO: 2.

In some embodiments, the modified IL-2 cytokine or functional fragment thereof comprises modifications R38A, F42A, Y45A, and E62A relative to the sequence of a mature IL-2 having SEQ ID NO: 2.

In some embodiments, the modified IL-2 cytokine or functional fragment thereof comprises the modification C125A relative to the sequence of a mature IL-2 having SEQ ID NO: 2.

In some embodiments, the modified IL-2 cytokine or functional fragment thereof comprises R38A, F42A, Y45A, E62A and C125A relative to the sequence of a mature IL-2 having SEQ ID NO: 2.

In some embodiments, the IL-2 cytokine or functional fragment thereof comprises an amino acid sequence of SEQ ID NO: 3.

In some embodiments, the masking moiety comprises IL-2Rβ or a fragment, portion or variant thereof.

In some embodiments, the IL-2Rβ or a fragment, portion or variant thereof comprises an amino acid sequence of SEQ ID NO: 4.

In some embodiments, the IL-2Rβ or a fragment, portion or variant thereof has a mutation at amino acid positions C122 as compared to IL-2β of SEQ ID NO: 4.

In some embodiments, the IL-2Rβ or a fragment, portion or variant thereof has a mutation at amino acid positions C168 as compared to IL-2β of SEQ ID NO: 4.

In some embodiments, the IL-2Rβ or a fragment, portion or variant thereof has mutations at amino acid positions C122 and C168 as compared to IL-2β of SEQ ID NO: 4.

In some embodiments, the IL-2Rβ or a fragment, portion or variant thereof has mutations C122S and C168S as compared to IL-2β of SEQ ID NO: 4.

In some embodiments, wherein the IL-2Rβ or a fragment, portion or variant thereof comprises an amino acid sequence of SEQ ID NO: 5.

In some embodiments, the cytokine moiety is an IL-12 cytokine moiety as described anywhere herein.

In some embodiments, the IL-12 cytokine moiety comprises a wild-type IL-12 cytokine moiety or variant thereof.

In some embodiments, the IL-12 cytokine moiety comprises an IL-12 cytokine or fragment thereof.

In some embodiments, the IL-12 cytokine or functional fragment thereof comprises an IL-12p40 polypeptide or functional fragment thereof covalently linked to an IL-12p35 polypeptide or functional fragment thereof.

In some embodiments, the IL-12p40-IL-12p35 linker is between 5 and 20 amino acids in length.

In some embodiments, the IL-12p40-IL-12p35 linker is rich in amino acid residues G and S.

In some embodiments, the IL-12p40-IL-12p35 linker comprises SEQ ID NO: 116 (GGGGSGGGGSGGGGS).

In some embodiments, the IL-12p40 polypeptide comprises SEQ ID NO: 204 (as shown in the IL-12 Cytokine Moieties table in the description) or an amino acid sequence having at least one amino acid modification as compared to the amino acid sequence of SEQ ID NO: 204 (as shown in the IL-12 Cytokine Moieties table in the description).

In some embodiments, the IL-12p40 polypeptide comprises SEQ ID NO: 204 (as shown in the IL-12 Cytokine Moieties table in the description).

In some embodiments, the IL-12p40 polypeptide comprises at least one amino acid modification to the GAG-binding domain (KSKREKKDRV (SEQ ID NO: 117)) as compared to the amino acid sequence of SEQ ID NO: 204 (as shown in the IL-12 Cytokine Moieties table in the description).

In some embodiments, the IL-12p40 polypeptide comprises SEQ ID NO: 205 (as shown in the IL-12 Cytokine Moieties table in the description).

In some embodiments, the IL-12p40 polypeptide comprises SEQ ID NO: 206 (as shown in the IL-12 Cytokine Moieties table in the description).

In some embodiments, the IL-12p40 polypeptide comprises an amino acid sequence having one or more cysteine substitution mutations as compared to the amino acid sequence of SEQ ID NO: 204 (as shown in the IL-12 Cytokine Moieties table in the description).

In some embodiments, the IL-12p40 polypeptide comprises SEQ ID NO: 207 (as shown in the IL-12 Cytokine Moieties table in the description).

In some embodiments, the IL-12p40 polypeptide comprises SEQ ID NO: 208 (as shown in the IL-12 Cytokine Moieties table in the description).

In some embodiments, the IL-12p35 polypeptide comprises SEQ ID NO: 209 (as shown in the IL-12 Cytokine Moieties table in the description) or an amino acid sequence having at least one amino acid modification as compared to the amino acid sequence of SEQ ID NO: 209 (as shown in the IL-12 Cytokine Moieties table in the description).

In some embodiments, the IL-12p35 polypeptide comprises SEQ ID NO: 209 (as shown in the IL-12 Cytokine Moieties table in the description).

In some embodiments, the IL-12 cytokine or functional fragment thereof comprises SEQ ID NO: 210 (as shown in the IL-12 Cytokine Moieties table in the description).

In some embodiments, the IL-12 cytokine or functional fragment thereof comprises SEQ ID NO: 211 (as shown in the IL-12 Cytokine Moieties table in the description).

In some embodiments, the IL-12 cytokine or functional fragment thereof comprises SEQ ID NO: 212 (as shown in the IL-12 Cytokine Moieties table in the description).

In some embodiments, the IL-12 cytokine or functional fragment thereof comprises SEQ ID NO: 213 (as shown in the IL-12 Cytokine Moieties table in the description).

In some embodiments, the IL-12 cytokine or functional fragment thereof comprises SEQ ID NO: 214 (as shown in the IL-12 Cytokine Moieties table in the description).

In some embodiments, the masking moiety comprises an IL-12 cytokine receptor, or a subunit or functional fragment thereof.

In some embodiments, the masking moiety comprises the extracellular domain of human IL-12Rβ1 or a fragment, portion, or variant thereof that retains or otherwise demonstrates an affinity to IL-12.

In some embodiments, the masking moiety comprises residues 24 to 237 of human IL-12Rβ1, namely a sequence having SEQ ID NO: 215 (as shown in the IL-12 Masking Moieties table in the description).

In some embodiments, the masking moiety comprises residues 24 to 545 of human IL-12Rβ1, namely a sequence having SEQ ID NO: 216 (as shown in the IL-12 Masking Moieties table in the description).

In some embodiments, the masking moiety comprises the extracellular domain of human IL-12Rβ2 or a fragment, portion, or variant thereof that retains or otherwise demonstrates an affinity to IL-12.

In some embodiments, the masking moiety comprises residues 24 to 212 of human IL-12Rβ2, namely a sequence having SEQ ID NO: 217 (as shown in the IL-12 Masking Moieties table in the description).

In some embodiments, the masking moiety comprises residues 24 to 222 of human IL-12Rβ2, namely a sequence having SEQ ID NO: 218 (as shown in the IL-12 Masking Moieties table in the description), or the masking moiety comprises residues 24 to 227 of human IL-12Rβ2, namely a sequence having SEQ ID NO: 222 (as shown in the IL-12 Masking Moieties table in the description).

In some embodiments, the masking moiety comprises residues 24 to 319 of human IL-12Rβ2, namely a sequence having SEQ ID NO: 219 (as shown in the IL-12 Masking Moieties table in the description).

In some embodiments, the masking moiety comprises at least one amino acid modification as compared to the sequence of SEQ ID NO: 219 (as shown in the IL-12 Masking Moieties table in the description), optionally wherein said modifications are cysteine substitution mutations.

In some embodiments, the masking moiety comprises SEQ ID NO: 220 (as shown in the IL-12 Masking Moieties table in the description).

In some embodiments, the masking moiety comprises residues 24 to 622 of human IL-12Rβ2, namely a sequence having SEQ ID NO: 221 (as shown in the IL-12 Masking Moieties table in the description).

In some embodiments, the cytokine moiety is an IL-15 cytokine moiety as described anywhere herein.

In some embodiments, the IL-15 cytokine moiety comprises a wild-type IL-15 cytokine moiety or variant thereof.

In some embodiments, the cytokine moiety is an IL-15 cytokine moiety and the masked cytokine further comprises a domain comprising an IL-15Rα subunit or a functional fragment thereof ('IL-15Rα domain').

In some embodiments, the cytokine moiety is an IL-15 cytokine moiety and the masked cytokine further comprises a domain comprising an IL-15Rα subunit or a functional fragment thereof ('IL-15Rα domain'), and the IL-15Rα domain and the IL-15 cytokine moiety are present in different polypeptide chains in the construct and the IL-15Rα domain is non-covalently linked to the IL-15 cytokine moiety.

The 'IL-15Rα domain' herein can consist of the sequence of the wild-type sushi domain sIL-15Rα or a variant thereof, such as the sequence of the wild-type sushi domain sIL-15Rα with one or more e.g. 1, 2, 3 or 4 amino acid substitutions. In some embodiments, the IL-15Rα domain comprises an amino acid substitution at position R26. In some embodiments, the IL-15Rα domain comprises amino acid substitution R26N. In some embodiments, the IL-15Rα domain comprises amino acid substitution R26S. In some embodiments, the IL-15Rα domain comprises an amino acid substitution at position R35. In some embodiments, the IL-15Rα domain comprises amino acid substitution R35Q. In some embodiments, the IL-15Rα domain comprises amino acid substitution R35S. In some embodiments, the IL-15Rα domain comprises an amino acid substitution at positions R26 and R35. In some embodiments, the IL-15Rα domain comprises amino acid substitutions R26S or R26N, and R35Q or R35S. In some embodiments, the IL-15Rα domain comprises amino acid substitutions R26N and R35Q.

In some embodiments, the IL-15 cytokine moiety comprises an IL-15 cytokine or fragment thereof.

In some embodiments, the IL-15 cytokine or fragment thereof comprises SEQ ID NO: 224 (as shown in the IL-15 Cytokine Moieties table in the description) or a functional fragment thereof.

In some embodiments, the IL-15 cytokine or functional fragment thereof comprises an amino acid sequence of SEQ ID NO: 224 (as shown in the IL-15 Cytokine Moieties table in the description).

In some embodiments, the IL-15 cytokine or functional fragment thereof comprises an amino acid sequence having at least one amino acid modification as compared to the amino acid sequence of SEQ ID NO: 224 (as shown in the IL-15 Cytokine Moieties table in the description).

In some embodiments, the IL-15 cytokine or functional fragment thereof comprises an amino acid sequence having one or more amino acid substitutions at positions D22, E46, E53 as compared to the amino acid sequence of SEQ ID NO: 224 (as shown in the IL-15 Cytokine Moieties table in the description).

In some embodiments, the IL-15 cytokine or functional fragment thereof comprises an amino acid sequence having one or more amino acid substitutions at positions D22, E46, E53, N71, N79, or N112 as compared to the amino acid sequence of SEQ ID NO: 224 (as shown in the IL-15 Cytokine Moieties table in the description).

In some embodiments, the IL-15 cytokine or functional fragment thereof comprises an amino acid sequence having an amino acid substitution at position N71 and N79 as compared to the amino acid sequence of SEQ ID NO: 224 (as shown in the IL-15 Cytokine Moieties table in the description).

In some embodiments, the IL-15 cytokine or functional fragment thereof comprises an amino acid sequence having an amino acid substitution at position N71 and N112 as compared to the amino acid sequence of SEQ ID NO: 224 (as shown in the IL-15 Cytokine Moieties table in the description).

In some embodiments, the IL-15 cytokine or functional fragment thereof comprises an amino acid sequence having an amino acid substitution at position N79 and N112 as compared to the amino acid sequence of SEQ ID NO: 224 (as shown in the IL-15 Cytokine Moieties table in the description).

In some embodiments, the IL-15 cytokine or functional fragment thereof comprises an amino acid sequence having an amino acid substitution at position N71, N79 and N112 as compared to the amino acid sequence of SEQ ID NO: 224 (as shown in the IL-15 Cytokine Moieties table in the description).

In some embodiments, the IL-15 cytokine or functional fragment thereof comprises an amino acid sequence of SEQ ID NO: 225 (as shown in the IL-15 Cytokine Moieties table in the description).

In some embodiments, the IL-15 cytokine or functional fragment thereof comprises an amino acid sequence of SEQ ID NO: 226 (as shown in the IL-15 Cytokine Moieties table in the description).

In some embodiments, the IL-15 cytokine or functional fragment thereof comprises an amino acid sequence of SEQ ID NO: 227 (as shown in the IL-15 Cytokine Moieties table in the description).

In some embodiments, the IL-15 cytokine or functional fragment thereof comprises an amino acid sequence of SEQ ID NO: 228 (as shown in the IL-15 Cytokine Moieties table in the description).

In some embodiments, the IL-15 cytokine or functional fragment thereof comprises an amino acid sequence of SEQ ID NO: 229 (as shown in the IL-15 Cytokine Moieties table in the description).

In some embodiments, the IL-15 cytokine or functional fragment thereof comprises an amino acid sequence of SEQ ID NO: 230 (as shown in the IL-15 Cytokine Moieties table in the description).

In some embodiments, the IL-15 cytokine or functional fragment thereof comprises an amino acid sequence of SEQ ID NO: 233 (as shown in the IL-15 Cytokine Moieties table in the description).

In some embodiments, the IL-15 cytokine or functional fragment thereof comprises an amino acid sequence of SEQ ID NO: 234 (as shown in the IL-15 Cytokine Moieties table in the description).

In some embodiments, the IL-15 cytokine or functional fragment thereof comprises an amino acid sequence of SEQ ID NO: 235 (as shown in the IL-15 Cytokine Moieties table in the description).

In some embodiments, the IL-15 cytokine or functional fragment thereof comprises an amino acid sequence of SEQ ID NO: 236 (as shown in the IL-15 Cytokine Moieties table in the description).

In some embodiments, the IL-15 cytokine or functional fragment thereof comprises an amino acid sequence of SEQ ID NO: 237 (as shown in the IL-15 Cytokine Moieties table in the description).

In some embodiments, the IL-15 cytokine or functional fragment thereof comprises an amino acid sequence of SEQ ID NO: 238 (as shown in the IL-15 Cytokine Moieties table in the description).

In some embodiments, the IL-15 cytokine or functional fragment thereof comprises an amino acid sequence of SEQ ID NO: 239 (as shown in the IL-15 Cytokine Moieties table in the description).

In some embodiments, the IL-15 cytokine or functional fragment thereof comprises an additional mutation at position N71.

In some embodiments, the IL-15 cytokine or functional fragment thereof comprises an additional mutation at position S73.

In some embodiments, the IL-15 cytokine or functional fragment thereof comprises an additional mutation at one or more of amino acid positions N72, N79, V80, T81, and N112.

In some embodiments, the masking moiety comprises IL-15Rβ or a fragment or variant thereof.

In some embodiments, the masking moiety comprises the amino acid sequence of SEQ ID NO: 240 (as shown in the IL-15 Masking Moieties table in the description).

In some embodiments, the masking moiety comprises IL-15Rβ variant or a fragment thereof having an amino acid substitution at position C122.

In some embodiments, the masking moiety comprises IL-15Rβ variant or a fragment thereof having amino acid substitution C122S.

In some embodiments, the masking moiety comprises IL-15Rβ variant or a fragment thereof having an amino acid substitution at position C168.

In some embodiments, the masking moiety comprises IL-15Rβ variant or a fragment thereof having amino acid substitution C168S.

In some embodiments, the masking moiety comprises IL-15Rβ variant or a fragment thereof having an amino acid substitution at positions C122 and C168.

Provided herein is a cleavage product capable comprising an active therapeutic moiety, preparable by proteolytic cleavage of the proteolytically cleavable linker in the polypeptide drug constructs as described anywhere herein.

Provided herein is a nucleic acid encoding any one of the polypeptide drug constructs as described anywhere herein described herein.

Provided herein is a nucleic acid encoding one of the chains of any one of the polypeptide drug constructs as described anywhere herein described herein.

Provided herein is a vector comprising a nucleic acid described herein.

Provided herein is a vector comprising a nucleic acid encoding a polypeptide drug construct as described anywhere herein described herein.

Provided herein is a vector comprising a nucleic acid encoding one of the chains of a polypeptide drug constructs as described anywhere herein described herein.

Provided herein is a host cell comprising a nucleic acid described herein.

In one embodiment, the host cell is a HEK cell. In another embodiment, the host cell is a CHO cell.

Provided herein is a composition comprising any one of the polypeptide drug constructs as described anywhere herein described herein.

Provided herein is a pharmaceutical composition comprising any one of the polypeptide drug constructs as described anywhere herein described herein, and a pharmaceutically acceptable carrier.

Provided herein is a kit comprising any one of the polypeptide drug constructs as described anywhere herein, or the compositions, or the pharmaceutical compositions described herein.

Provided herein is a method of producing any one of the polypeptide drug constructs as described anywhere herein, comprising culturing a host cell described herein under a condition that produces the polypeptide drug construct.

Provided herein is a nucleic acid encoding any one of the cleavage products described herein.

Provided herein is a composition comprising any one of the cleavage products described herein.

Provided herein is a pharmaceutical composition comprising any one of the cleavage products described herein, and a pharmaceutically acceptable carrier.

Provided herein is a polypeptide drug construct as described herein for use in medicine.

Provided herein is a cleavage product as described herein for use in medicine.

Provided herein is a method of treating or preventing cancer in a subject, the method comprising administering to the subject an effective amount of a polypeptide drug construct as described herein.

Provided herein is a method of treating or preventing cancer in a subject, the method comprising administering to the subject an effective amount of a composition as described herein.

Provided herein is a method of treating or preventing cancer in a subject, the method comprising administering to the subject an effective amount of a pharmaceutical composition as described herein.

Provided herein is a method of treating or preventing cancer in a subject, the method comprising administering to the subject an effective amount of a polypeptide drug construct as described herein, whereby the polypeptide drug construct is proteolytically cleaved in vivo to produce a cleavage product as described herein.

Provided herein is a method of treating or preventing cancer in a subject, the method comprising a step of producing a cleavage product in vivo that is capable of binding to its target protein, where the cleavage product is as described herein.

Provided herein is a polypeptide drug construct as described herein for use in treating or preventing cancer.

Provided herein is a polypeptide drug construct as described herein for use in a method of treating or preventing cancer, the method comprising administering to the subject an effective amount of the polypeptide drug construct, whereby the polypeptide drug construct is proteolytically cleaved in vivo to produce a cleavage product as described herein.

Provided herein is a cleavage product as described herein for use in treating or preventing cancer.

Provided herein is a cleavage product as described herein for use in treating or preventing cancer, the method comprising a step of administering a polypeptide drug construct as described herein to a patient, thereby producing the cleavage product by proteolytic cleavage of the masked cytokine in vivo.

Provided herein is a cleavage product as described herein for use in a method of treating or preventing cancer in a subject, the method comprising a step of producing the cleavage product by in vivo proteolytic cleavage from a polypeptide drug construct as described herein that has been administered to the subject.

BRIEF DESCRIPTION OF THE DRAWINGS

FIG. 1 shows the structure of an exemplary embodiment of a masked cytokine as a monomer.

FIGS. 3A-B show exemplary embodiments of a masked IL-2 cytokine. Cleavage by a protease releases a masking moiety (e.g., IL-2Rβ, as shown in FIG. 3B), or releases an IL-2 (FIG. 3A).

FIGS. 5A-D show results from SPR analysis that tested the binding of an exemplary masked IL-2 polypeptide construct (AK168), or a rhIL-2 control, to CD25-Fc. FIG. 5A shows the interaction between AK168 and CD25-Fc, FIG. 5B shows the interaction between AK168 activated with MMP and CD25-Fc, and FIG. 5C shows the interaction between a recombinant human IL-2 (rhIL2) control and CD25-Fc. FIG. 5D provides a table summarizing the data obtained for the association constant (ka), dissociation constant (kd), equilibrium dissociation constant (KD), as well as the Chi2 value and U-value for each interaction.

FIGS. 6A-D show results from SPR analysis that tested the binding of an exemplary masked IL-2 polypeptide constructs (AK111), or a rhIL2 control, to CD122-Fc. FIG. 6A shows the interaction between AK11 and CD122-Fc, FIG. 6B shows the interaction between AK111 activated with protease and CD122-Fc, and FIG. 6C shows the interaction between a recombinant human IL-2 (rhIL-2) control and CD122-Fc. FIG. 6D provides a table summarizing the data obtained for the association constant (ka), dissociation constant (kd), equilibrium dissociation constant (KD), as well as the Chi2 value and U-value for each interaction.

FIGS. 9A-C show STAT5 activation (%) in PBMCs treated with the construct AK081 or AK032. The AK081 construct with and without prior exposure to MMP10 was tested. An isotype control as well as a no IL-2 negative control was also tested. The levels of STAT5 activation (%) are shown for NK cells (FIG. 9A), CD8+ T cells (FIG. 9C), and CD4+ T cells (FIG. 9B).

FIG. 10D provides EC50 (pM) and fold-change data for the AK081, AK111 constructs, as well as the rhIL-2 control.

FIGS. 11A-D show the results from STAT5 activation studies in PBMCs using constructs AK167 and AK168, as well as controls that included an rhIL-2 and anti-RSV antibody. A no-treatment control was also tested. EC50 (pM) is also shown for the rhIL-2, AK167, and AK168 treatments. STAT5 activation (%) is shown for CD4+FoxP3+CD25+ cells (FIG. 11A), CD8+ cells (FIG. 11B), and CD4+FoxP3-CD25- cells (FIG. 11C). FIG. 11D provides EC50 (pM) and fold-change data for the AK167 and AK168 constructs, as well as the rhIL-2 control.

FIGS. 13A-13C show STAT5 activation (%) in PBMCs treated with the construct AK109 or AK110, or an isotype control or an IL-2-Fc control, that were (+MMP10) or were not previously exposed to the MMP10 protease. The key as shown in FIG. 12B also applies to FIG. 13A. STAT5 activation (%) is shown for NK cells (FIG. 13A), CD8 cells (FIG. 13B), and CD4 cells (FIG. 13C).

FIGS. 14A-14D show the results from STAT5 activation studies in PBMCs using the constructs AK211, AK235, AK253, AK306, AK310, AK314, and AK316, as well as an rhIL-2 control. STAT5 activation (%) is shown for CD3+CD4+FoxP3+ cells (FIG. 14A), CD3+CD4+FoxP3- cells (FIG. 14B), and CD3+CD8+ cells (FIG. 14C). FIG. 14D provides EC50 data for each of the tested constructs as well as the rhIL-2 control.

FIG. 15D provides EC50 data for each of the tested constructs as well as the rhIL-2 control.

FIG. 18A provides a simplistic depiction of the structure of each of the constructs tested. FIG. 18B shows Fc levels in plasma (μg/mL) by detecting human IgG, FIG. 18C shows Fc-CD122 levels in plasma (μg/mL) by detecting human CD 122, and FIG. 18D shows Fc-IL2 levels in plasma (μg/mL) by detecting human IL-2. Prior to the detection step, an anti-human IG was used as the capture antibody.

FIGS. 19A-19D show results from pharmacokinetic studies carried out in tumor-bearing mice using the construct AK167, AK191 AK197, AK203, AK209, or AK211, or an anti-RSV control. FIG. 19A provides a simplistic depiction of the structure of each of the constructs tested. FIG. 19B shows Fc levels in plasma (μg/mL) by detecting human IgG, FIG. 19C shows Fc-IL2 levels in plasma (μg/mL) by detecting human IL-2, and FIG. 19D shows Fc-CD122 levels in plasma (μg/mL) by detecting human CD 122. Prior to the detection step, an anti-human IG was used as the capture antibody.

FIGS. 20A-20L show results from studies testing the in vivo responses of CD4, CD8, NK, and Treg percentages in spleen, blood, and tumor, using the AK032, AK081, AK111, AK167, or AK168 construct, or an anti-RSV IgG control. For spleen tissue, % CD8 cells of CD3 cells (FIG. 20A), % CD4 of CD3 cells (FIG. 20B), % NK cells of CD3- cells (FIG. 20C), % FoxP3 of CD4 cells (FIG. 20D) is shown. For blood, % CD8 cells of CD3 cells (FIG. 20E), % CD4 of CD3 cells (FIG. 20F), % NK cells of CD3- cells (FIG. 20G), % FoxP3 of CD4 cells (FIG. 20H) is shown. For tumor tissue, % CD8 cells of CD3 cells (FIG. 20I), % CD4 of CD3 cells (FIG. 20J), % NK cells of CD3- cells (FIG. 20K), % FoxP3 of CD4 cells (FIG. 20L) is shown.

FIGS. 23A-23I show results from in vivo T cell activation in spleen, blood, and tumor, using the AK235, AK191, AK192, AK193, AK210, AK189, AK190, or AK211 construct. T cell activation was measured as the mean fluorescence intensity (MFI) of CD25 in CD8+ T cells (FIG. 23A; FIG. 23D; FIG. 23G), CD4+ T cells (FIG. 23B; FIG. 23E; FIG. 23H), or Foxp3+ cells (FIG. 23C; FIG. 23F; FIG. 23I) in the spleen, blood, and tumor. Statistical analysis was performed using One-way ANOVA as compared to the non-cleavable AK211 construct.

FIGS. 24A-24D show the results from studies testing the in vivo cleavage of the exemplary masked IL-2 polypeptide constructs AK168 (cleavable peptide sequence: MPYDLYHP; SEQ ID NO: 24) and AK209 (cleavable peptide sequence: VPLSLY; SEQ ID NO: 28).

FIGS. 25A-25D show results from an in vivo study that assessed vascular leakage using the exemplary masked IL-2 polypeptide construct AK111 or AK168, or the non-masked IL-2 polypeptide construct AK081 or AK167, or an anti-RSV control. FIG. 25A shows the percentage (%) of body weight loss, and FIGS. 25B, 25C, and 25D show the weight in grams of the liver, lung, and spleen, respectively, for each.

FIG. 28A shows data on tumor volume over the course of treatment, and FIG. 28B shows data on the percentage (%) change in body weight over the course of the treatment.

FIG. 40A shows tumor volume over time for different constructs comprising VPLSLY cleavable substrate and FIG. 40C shows the corresponding changes in body weights. FIG. 40B shows tumor volume over time for different constructs comprising MPYDLYHP cleavable substrate and FIG. 40D shows the corresponding changes in body weights.

FIGS. 44A-D and FIGS. 45A-F show the results of a SDS-PAGE and HEK-Blue IL-2 bioassay using exemplary IL-15 constructs AK904 and AK910 that do not include a peptide substrate, and constructs AK932, AK938, AK930 and AK936 that do include a peptide substrate. FIGS. 44A-D show the SDS-PAGE gel results. FIGS. 45A-F show the HEK-Blue IL-2 bioassay results.

FIG. 52C shows EC50 value for AK671 construct in absence of any protease or in presence of MMP 7, MMP 9, or MMP 10 protease.

FIG. 52D shows EC50 value for AK918 construct in absence and presence of MMP 7 protease.

FIG. 52E shows EC50 value for AK919 construct in absence and presence of MMP 7 protease.

FIG. 52F shows EC50 value for AK920 construct in absence and presence of MMP 9 protease.

FIG. 55A shows the percentage (%) of body weight loss, FIG. 55B shows the volume in mm3 of tumor, and FIGS. 55C and D show the weight in grams of the lung and spleen, respectively, five days after treatment. Statistical analysis was performed using One-way ANOVA as compared to the vehicle group (*P<0.05; P<0.01; *P<0.001; ****P<0.0001).

FIG. 61A shows the percentage (%) of body weight loss, FIG. 60B shows the volume in mm3 of tumor, and FIGS. 61C and D show the weight in grams of the lung and spleen, respectively, five days after treatment. Statistical analysis was performed using One-way ANOVA as compared to the vehicle group (*P<0.05; P<0.01; *P<0.001; ****P<0.0001).

FIG. 62A shows Fc levels in plasma (ng/mL) by detecting human IgG. FIGS. 62B-D show the half-life, Cmax, and AUC(0-last) calculated by WinNonlin software from the results in FIG. 62A.

FIG. 68 shows the schematics of the constructs used in Example 4.

FIG. 69 shows the schematics of the constructs used in Example 8.

DETAILED DESCRIPTION

1. Polypeptide Drug Constructs

Figure 1:
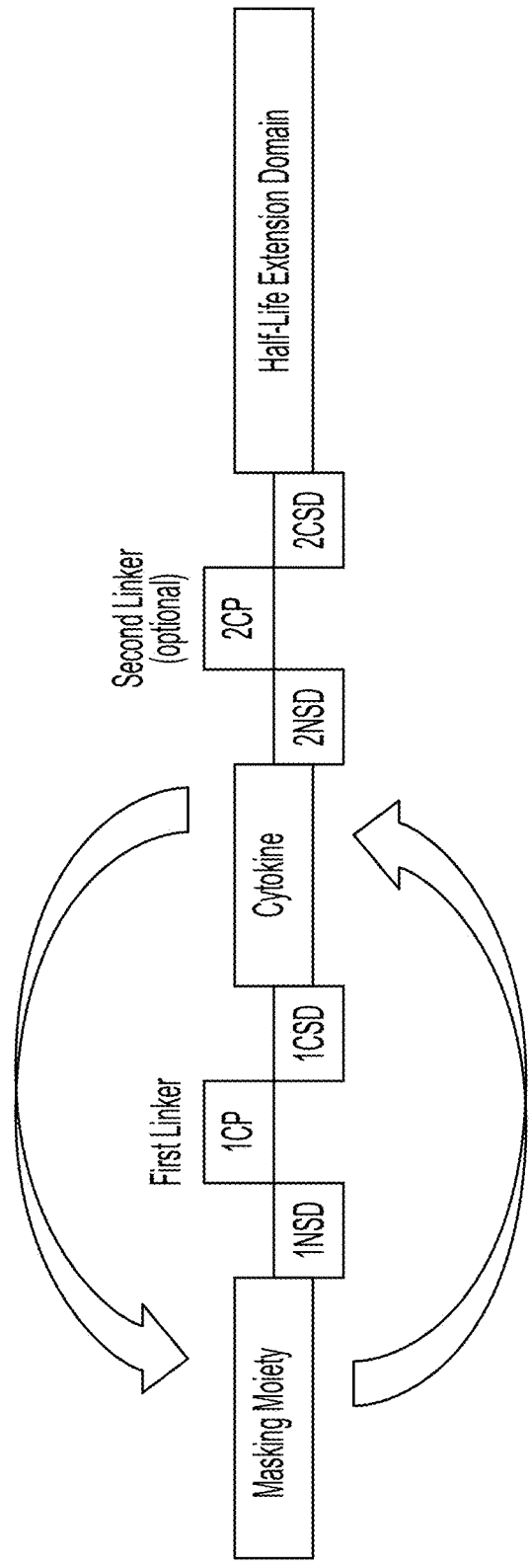
FIG. 1 shows the structure of exemplary embodiments of a masked cytokine that includes a masking moiety, a cytokine or functional fragment thereof ("cytokine"), a half-life extension moiety, and a first linker that includes a first cleavable peptide ("1CP"), a first N-terminal spacer domain ("1NSD"), and a first C-terminal spacer domain ("1CSD"). These exemplary embodiments also include a second linker that includes a second cleavable peptide ("2CP"), a second N-terminal spacer domain ("2NSD"), and a second C-terminal spacer domain ("2CSD"). As shown by the arrows, while the exemplary embodiments show the masking moiety linked to the first linker, and the cytokine or functional fragment thereof is linked to the first linker and the second linker, the masking moiety and the cytokine or functional fragment thereof can be interchanged such that the cytokine or functional fragment thereof is linked to the first linker, and the masking moiety is linked to the first linker and the second linker.
Figure 2:
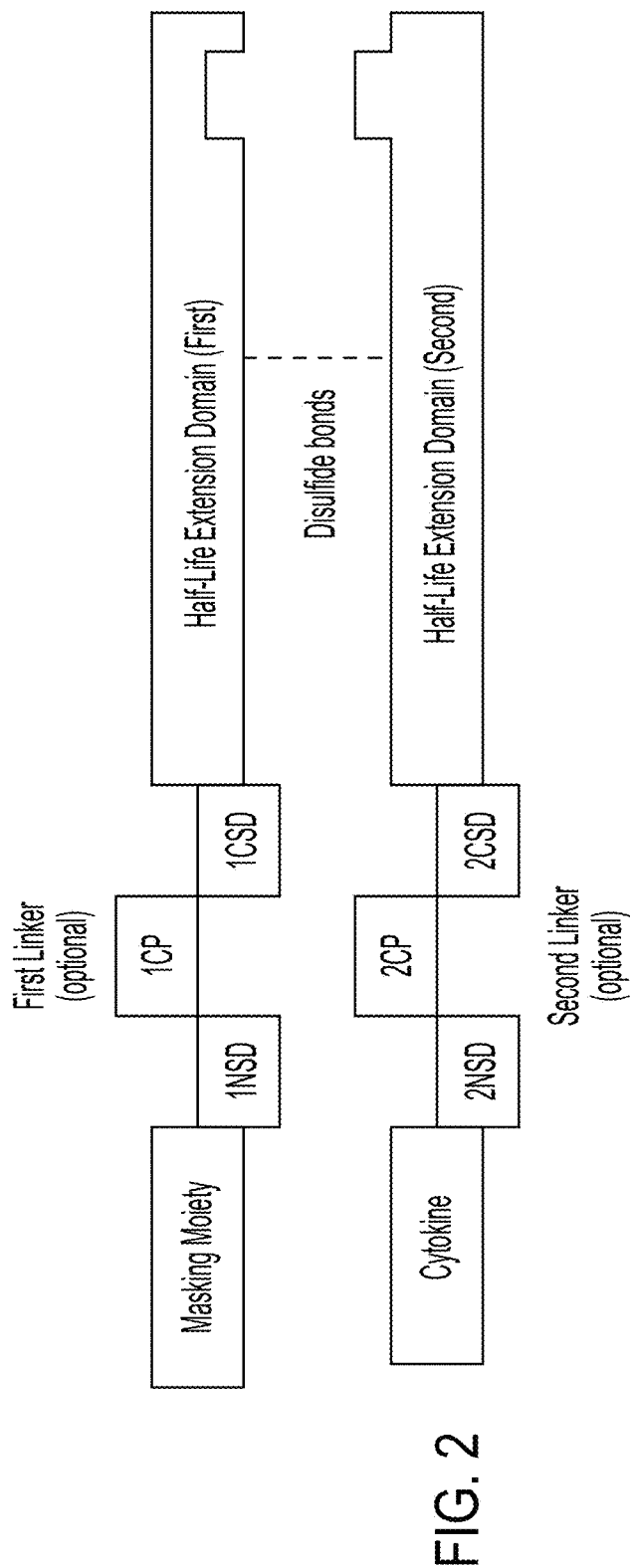
FIG. 2 shows the structure of an exemplary embodiment of a masked cytokine that includes a masking moiety, a cytokine or functional fragment thereof ("cytokine"), a first half-life extension moiety, and a second half-life extension moiety. The exemplary embodiment shown in FIG. 2 also includes a first linker that includes a first cleavable peptide ("1CP"), a first N-terminal spacer domain ("1NSD"), and a first C-terminal spacer domain ("1CSD"), and a second linker that includes a second cleavable peptide ("2CP"), a second N-terminal spacer domain ("2NSD"), and a second C-terminal spacer domain ("2CSD"). The exemplary first and second half-life extension moieties include "knobs into holes" modifications that promote the association of the first half-life extension moiety with the second half-life extension moiety, as shown by the "hole" in the first half-life extension moiety and the "knob" in the second half-life extension moiety. The first half-life extension moiety and the second half-life extension moiety are also shown as associating, at least in part, due to the formation of disulfide bonds. It is to be understood that although the "hole" is depicted as part of the first half-life extension moiety (linked to the masking moiety) and the "knob" is depicted as part of the second half-life extension moiety (linked to the cytokine), the "hole" and the "knob" can alternatively be included in the second half-life extension moiety and the first half-life extension moiety, respectively, so that the "hole" is a part of the second half-life extension moiety (linked to the cytokine) and the "knob" is part of the first half-life extension moiety (linked to masking moiety).
Figure 3A:
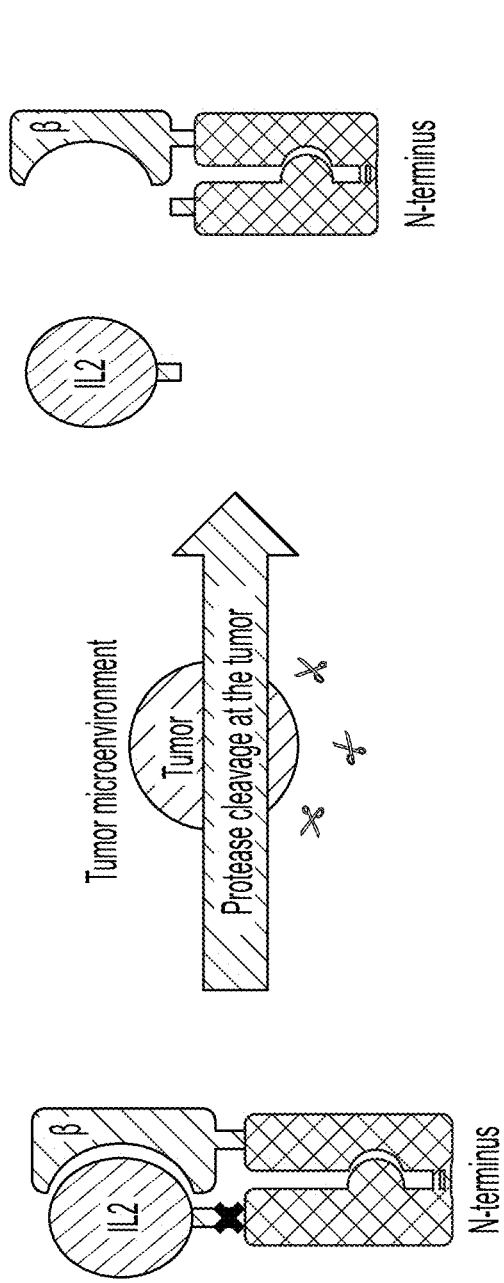
FIGS. 3A-B show exemplary embodiments of masked cytokines prior to (left) and after (right) cleavage by a protease, such as at the tumor microenvironment.
Figure 3B:
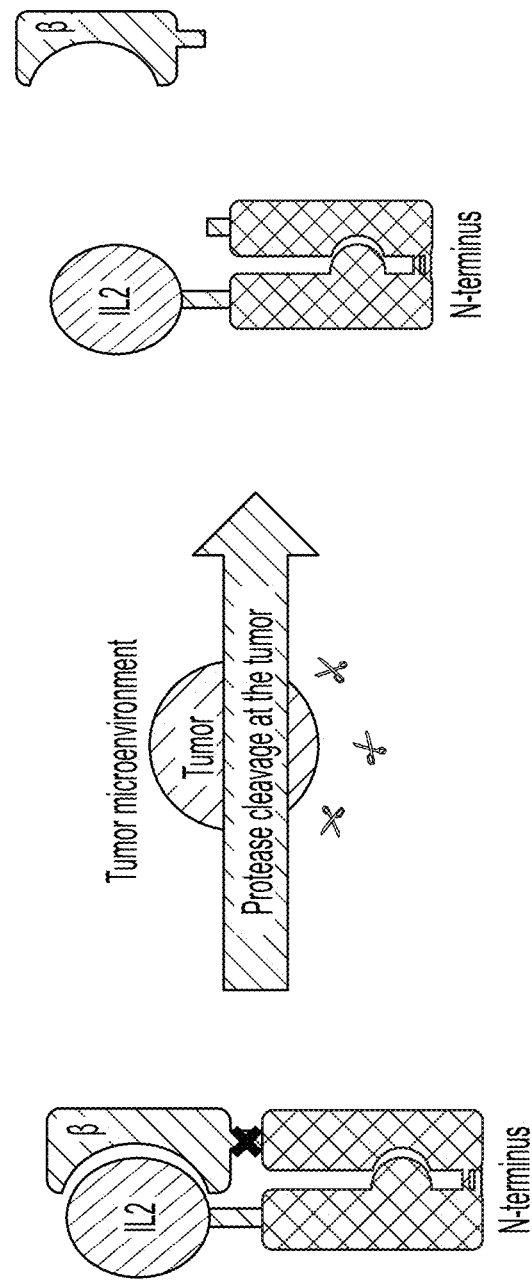

This invention provides novel tumor-specific proteolytically cleavable peptide linkers and their use in polypeptide drug constructs for delivering a therapeutic moiety to a tumor cell environment. The proteolytically cleavable peptide linker is positioned within the polypeptide drug construct so that when the linker cleaves by protease action in the tumor cell environment, the polypeptide drug construct separates. This invention also relates to cleavage products of said drug constructs, and methods related to the use of the same.

Protease substrate amino acid sequences DLLAVVAAS (SEQ ID NO: 248) and ISSGLLSGRS (SEQ ID NO: 249) have been found to demonstrate very specific cleavage in the tumor cell environment compared to non-tumor cell environment. Thus, these proteolytically cleavable peptides advantageously can be used in proteolytically cleavable peptide linkers in polypeptide drug constructs, wherein any systemic side effects of the administered protein therapeutic may be reduced.

The proteolytically cleavable peptide linker may be bonded directly or indirectly to the therapeutic moiety within the polypeptide drug construct. Where the polypeptide drug construct comprises more than one polypeptide chain, the proteolytically cleavable peptide linker may be present in the same polypeptide chain as the therapeutic moiety or in a different polypeptide chain.

The part of the construct other than the therapeutic moiety can be considered as a carrier moiety. Where the proteolytically cleavable peptide linker is covalently bonded directly to the therapeutic moiety, the proteolytically cleavable peptide linker will be located within the drug construct between the therapeutic moiety and the carrier moiety. Alternatively, the proteolytically cleavable peptide linker may be located within the carrier moiety such that the molecule that separates away after cleavage comprises the therapeutic moiety and a part of the carrier moiety.

The polypeptide drug construct comprising the tumor-specific proteolytically cleavable peptide linkers may be a prodrug. Where the tumor-specific cleavable linker is used in a prodrug for delivering a therapeutic moiety to a tumor cell environment, the remainder of the molecule from which the therapeutic moiety separates away after cleavage may comprise a masking moiety, which inhibits the biological activity of the therapeutic moiety in the prodrug such that the therapeutic moiety is biologically active only after cleavage of the proteolytically cleavable peptide linker in the tumor cell environment. The masking moiety may be present in the same polypeptide chain as the therapeutic moiety. Alternatively, the masking moiety may be present in a first polypeptide chain and the therapeutic moiety may be present in a second polypeptide chain. The proteolytically cleavable peptide linker may be present in the first or second polypeptide chain.

By using a masking moiety, the systemic side effects of an administered protein therapeutic can be reduced by interfering with the binding capability of the therapeutic. By masking the therapeutic using a proteolytically cleavable peptide linker, the binding capability that is interfered with by using the masking moiety can be restored by cleavage of the proteolytically cleavable peptide linker at the tumor microenvironment. Thus, the prodrugs provided herein are engineered to precisely target pharmacological activity to the tumor microenvironment by exploiting one of the hallmarks of cancer, high local concentrations of active protease. This feature of the tumor microenvironment is used to transform a systemically inert molecule into a locally active molecules in the form of a cleavage product. Activation of the therapeutic moiety at the tumor microenvironment significantly reduces systemic toxicities that can be associated with drugs that are administered to a subject in active form.

In some embodiments, the drug construct provided herein comprises half-life extension moiety. A long half-life in vivo is important for therapeutic proteins. Unfortunately, therapeutics that are administered to a subject can have a short half-life since they are normally cleared rapidly from the subject by mechanisms including clearance by the kidney and endocytic degradation. Thus, in the drug constructs provided herein, a half-life extension moiety may be included for the purpose of extending the half-life of the therapeutic moiety in vivo.

Proteolytically Cleavable Peptide Linkers

The proteolytically cleavable peptide linkers described herein comprising a proteolytically cleavable peptide (CP) consisting of the amino acid sequence DLLAVVAAS (SEQ ID NO: 248) or ISSGLLSGRS (SEQ ID NO: 249).

In some embodiments, the proteolytically cleavable peptide linker is from 9 to 25 amino acids in length.

In some embodiments, the proteolytically cleavable peptide linker is from 10 to 25 amino acids in length.

In some embodiments, the proteolytically cleavable peptide linker is from 12 to 18 amino acids in length.

In some embodiments, the proteolytically cleavable peptide linker comprises a proteolytically cleavable peptide (CP) flanked on both sides by a spacer domain (SD1 and SD2) as shown below:

SD1-CP-SD2

In some embodiments, the proteolytically cleavable peptide (CP) consists of the amino acid sequence DLLAVVAAS (SEQ ID NO: 248).

In some embodiments, the proteolytically cleavable peptide (CP) consists of the amino acid sequence ISSGLLSGRS (SEQ ID NO: 249).

A spacer domain may consist of one or more amino acids. The function of the spacer domains, where present, is to link the proteolytically cleavable peptide (CP) to the other functional components in the constructs described herein.

It will be understood that spacer domains do not alter the biological interaction of the proteolytically cleavable peptide with proteases in the tumor-cell environment or in non-tumor cell environment. In other words, even in the presence of spacer domains the inventive proteolytically cleavable peptides disclosed herein retain their advantageous tumor specificity.

In some embodiments, the spacer domains flanking the proteolytically cleavable peptide are different.

In some embodiments, the spacer domains are rich in amino acid residues G, S and P.

In some embodiments, the spacer domains only includes amino acid residue types selected from the group consisting of G, S and P.

In some embodiments, the first spacer domain (SD1) is between 3 and 10 amino acids in length. In some embodiments, the first spacer domain (SD1) is between 4 and 9 amino acids in length. In some embodiments, the first spacer domain (SD1) is between 3 and 6 amino acids in length.

Exemplary SD1 sequences are shown below:

| | Sequence of SD1 | |
|---|---|---|
| GGPS | | (SEQ ID NO: 250) |
| GSGPS | | (SEQ ID NO: 251) |
| GSSGGP | | (SEQ ID NO: 252) |
| GSP | | |
| GSGSPS | | (SEQ ID NO: 254) |

In some embodiments, the first spacer domain (SD1) has a sequence as shown in the table above.

In some embodiments, the C-terminus sequence of SD2 is -GP C'.

In some embodiments, the sequence of the C-terminus of SD2 is SEQ ID NO: 29.

In some embodiments, the second spacer domain (SD2) is between 3 and 6 amino acids in length.

In some embodiments, SD2 comprises the amino acid sequence SGP.

In some embodiments, SD2 has the amino acid sequence SGP.

Exemplary combinations of SD1 and SD2 in a cleavable linker are shown below:

| Linker structure | SD1 sequence | SD2 sequence |
|---|---|---|
| SD1-CP-SD2 | GGPS | SGP |
| SD1-CP-SD2 | GSGPS | SGP |
| SD1-CP-SD2 | GSSGGP | SGP |
| SD1-CP-SD2 | GSP | SGP |
| SD1-CP-SD2 | GSGSPS | SGP |

In some embodiments, the second spacer domain (SD2) has a sequence as shown in the table above.

In some embodiments, the proteolytically cleavable linker comprises SD1-CP-SD2 where SD1 is a first spacer domain, CP is a cleavable peptide having an amino acid sequence DLLAVVAAS (SEQ ID NO: 248), and SD2 is a second spacer domain. In some embodiments, the spacer domains are rich in amino acid residues G, S and P. In some embodiments, the spacer domains only include amino acid residue types selected from the group consisting of G, S and P. In some embodiments, SD2 has the amino acid sequence SGP.

In some embodiments, the proteolytically cleavable linker comprises SD1-CP-SD2 where SD1 is a first spacer domain, CP is a cleavable peptide having an amino acid sequence ISSGLLSGRS (SEQ ID NO: 249), and SD2 is a second spacer domain. In some embodiments, the spacer domains are rich in amino acid residues G, S and P. In some embodiments, the spacer domains only include amino acid residue types selected from the group consisting of G, S and P. In some embodiments, SD2 has the amino acid sequence SGP.

Exemplary cleavable linkers using the DLLAVVAAS (SEQ ID NO: 248) cleavage peptide are shown below:

```
Cleavable linker sequence (cleavable
peptide shown in bold)
GGPSDLLAVVAASSGP

GSGPSDLLAVVAASSGP

GSSGGPDLLAVVAASSGP

GSPDLLAVVAASSGP

GSPGDLLAVVAASSGP

GSGSPSDLLAVVAASSGP

SGSDLLAVVAASSGPGSG

SGSPSGDLLAVVAASSGPGSGSP
```

In some embodiments, the cleavable linker comprises sequence GGPSDLLAVVAASSGP (SEQ ID NO: 245).

In some embodiments, the cleavable linker comprises sequence GSGPSDLLAVVAASSGP (SEQ ID NO: 246).

In some embodiments, the cleavable linker comprises sequence GSSGGPDLLAVVAASSGP (SEQ ID NO: 247).

In some embodiments, the cleavable linker comprises sequence GSPDLLAVVAASSGP (SEQ ID NO: 242).

In some embodiments, the cleavable linker comprises sequence GSPGDLLAVVAASSGP (SEQ ID NO: 243).

In some embodiments, the cleavable linker comprises sequence GSGSPSDLLAVVAASSGP (SEQ ID NO: 244).

In some embodiments, the cleavable linker has a sequence GGPSDLLAVVAASSGP (SEQ ID NO: 245).

In some embodiments, the cleavable linker has a sequence GSGPSDLLAVVAASSGP (SEQ ID NO: 246).

In some embodiments, the cleavable linker has a sequence GSSGGPDLLAVVAASSGP (SEQ ID NO: 247).

In some embodiments, the cleavable linker has a sequence GSPDLLAVVAASSGP (SEQ ID NO: 242).

In some embodiments, the cleavable linker has a sequence GSPGDLLAVVAASSGP (SEQ ID NO: 243).

In some embodiments, the cleavable linker has a sequence GSGSPSDLLAVVAASSGP (SEQ ID NO: 244).

In some embodiments, the cleavable linker has a sequence SGSDLLAVVAASSGPGSG (SEQ ID NO: 118).

In some embodiments, the cleavable linker has a sequence SGSPSGDLLAVVAASSGPGSGSP (SEQ ID NO: 119).

Exemplary cleavable linkers using the ISSGLLSGRS (SEQ ID NO: 249) cleavage peptide are shown below:

```
Cleavable linker sequence (cleavable peptide
shown in bold)
GGSSGGSPISSGLLSGRSSGPGSGS

GPPSGSSPISSGLLSGRSSGGG

GGSGGSISSGLLSGRSSGP

GGSGGSGGSISSGLLSGRSSGP
```

In some embodiments, the cleavable linker has a sequence GGSSGGSPISSGLLSGRSSGPGSGS (SEQ ID NO: 112).

In some embodiments, the cleavable linker has a sequence GPPSGSSPISSGLLSGRSSGGG (SEQ ID NO: 113).

In some embodiments, the cleavable linker has a sequence GGSGGSISSGLLSGRSSGP (SEQ ID NO: 114).

In some embodiments, the cleavable linker has a sequence GGSGGSGGSISSGLLSGRSSGP (SEQ ID NO: 115).

Linker combinations disclosed in exemplary AK molecules may be used with any cytokine moiety disclosed herein. Linker combinations disclosed in exemplary AK molecules may be used with any masking moiety disclosed herein disclosed herein. Linker combinations disclosed in exemplary AK molecules may be used with any half-life extension moieties. In other words, the linkers disclosed in exemplary AK molecules may be used in combinations with any cytokine moiety disclosed herein, masking moiety disclosed herein and/or half-life extension moiety disclosed herein.

Half-Life Extension Moieties

A long half-life in vivo is important for therapeutic proteins.

The term "half-life extension moiety" encompasses, for example, PEG, albumin, antibodies and antibody fragments.

The half-life extension moiety may comprise an antibody or fragment thereof.

An antibody or fragment thereof that is capable of FcRn-mediated recycling, can be reduce or otherwise delay clearance of the drug construct from a subject, thereby prolonging the half-life of the administered drug construct. In some embodiments, the antibody or fragment thereof is any antibody or fragment thereof that is capable of FcRn-mediated recycling, such as any heavy chain polypeptide or portion thereof (e.g., Fc domain or fragment thereof) that is capable of FcRn-mediated recycling.

The antibody or fragment thereof can be any antibody or fragment thereof. However, in some embodiments of a drug construct comprising a first half-life extension moiety and a second half-life extension moiety, either the first half-life extension moiety or the second half-life extension moiety may comprise an antibody or fragment thereof that does not bind to the FcRn receptor, such as a light chain polypeptide. For example, in some embodiments of the drug construct, a first half-life extension moiety comprises an antibody or fragment thereof that comprises a light chain polypeptide or portion thereof that does not directly interact with the FcRn receptor, but the drug construct nonetheless has an extended half-life due to comprising a second half-life extension moiety that is capable of interacting with the FcRn receptor, such as by comprising a heavy chain polypeptide. It is recognized in the art that FcRn-mediated recycling requires binding of the FcRn receptor to the Fc region of the antibody or fragment thereof. For instance, studies have shown that residues I253, S254, H435, and Y436 (numbering according to the Kabat EU index numbering system) are important for the interaction between the human Fc region and the human FcRn complex. See, e.g., Firan, M., et al., Int. Immunol. 13 (2001) 993-1002; Shields, R. L., et al, J. Biol. Chem. 276 (2001) 6591-6604). Various mutants of residues 248-259, 301-317, 376-382, and 424-437 (numbering according to the Kabat EU index numbering system) have also been examined and reported. Yeung, Y. A., et al. (J. Immunol. 182 (2009) 7667-7671.

In some embodiments, the antibody or fragment thereof comprises either a heavy chain polypeptide or a light chain polypeptide. In some embodiments, the antibody or fragment thereof comprises a portion of either a heavy chain polypeptide or a light chain polypeptide. In some embodiments, the antibody or fragment thereof comprises an Fc domain or fragment thereof. In some embodiments, the antibody or fragment thereof comprises a CH2 and CH3 domain or a fragment thereof. In some embodiments, the antibody or fragment thereof comprises the constant domain of the heavy chain polypeptide. In some embodiments, the antibody or fragment thereof comprises the constant domain of the light chain polypeptide. In some embodiments, the antibody or fragment thereof comprises a heavy chain polypeptide or fragment thereof (e.g., an Fc domain or fragment thereof). In some embodiments, the antibody or fragment thereof comprises a light chain polypeptide.

In some embodiments, the first half-life extension moiety comprises a first Fc domain or a fragment thereof and the second half-life extension moiety comprises a second Fc domain or a fragment thereof.

In some embodiments, the first and/or second Fc domains each contain one or more modifications that promote the non-covalent association of the first and the second half-life extension moieties. In some embodiments, the first half-life extension moiety comprises an IgG1 Fc domain or fragment thereof including the mutations Y349C; T366S; L38A; and Y407V to form a 'hole' in the first half-life extension moiety and the second half-life extension moiety comprises an IgG1 Fc domain or fragment thereof including the mutations S354C and T366W to form the 'knob' in the second half-life extension moiety.

In some embodiments, the first and second half-life extension moieties are each an IgG1, IgG2 or IgG4 Fc domain or fragment thereof. In some embodiments, the first and second half-life extension moieties are each an IgG1 Fc domain or fragment thereof. Human IgG1 Immunoglobulin heavy constant gamma 1 has the sequence:

(SEQ ID NO: 6)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKKVEP

KSCDKTHTCPPCPAPELLGGPSVFLFPPKPKDTLMISRTPEVTCVVVDVS

HEDPEVKFNWYVDGVEVHNAKTKPREEQYNSTYRVVSVLTVLHQDWLNGK

EYKCKVSNKALPAPIEKTISKAKGQPREPQVYTLPPSRDELTKNQVSLTC

LVKGFYPSDIAVEWESNGQPENNYKTTPPVLDSDGSFFLYSKLTVDKSRW

QQGNVFSCSVMHEALHNHYTQKSLSLSPGK

In some embodiments, the first and second half-life extension moieties are derived from the sequence for human IgG1 Immunoglobulin heavy constant gamma 1 having SEQ ID NO: 6 (the 'parent sequence'), such that the first and second half-life extension moieties each comprise SEQ ID NO: 6 or fragment thereof, with one or more amino acid modifications.

In some embodiments, the first and second half-life extension moieties each comprise the portion of SEQ ID NO: 6 shown in bold above, optionally with one or more amino acid modifications, i.e.:

(SEQ ID NO: 7)
DKTHTCPPCPAPELLGGPSVFLFPPKPKDTLMISRTPEVTCVVVDVSHED

PEVKFNWYVDGVEVHNAKTKPREEQYNSTYRVVSVLTVLHQDWLNGKEYK

CKVSNKALPAPIEKTISKAKGQPREPQVYTLPPSRDELTKNQVSLTCLVK

GFYPSDIAVEWESNGQPENNYKTTPPVLDSDGSFFLYSKLTVDKSRWQQG

NVFSCSVMHEALHNHYTQKSLSLSPG

In some embodiments, the first and second half-life extension moieties comprise SEQ ID NO: 7 with amino substitutions to promote association of the first and second half-life extension moieties according to the 'knob into holes' approach. In some embodiments, the sequence SEQ ID NO: 7 contains mutations Y349C; T366S; L38A; and Y407V (numbered according to the Kabat EU numbering system) to form the 'hole' in the first half-life extension moiety and mutations S354C and T366W (numbered according to the Kabat EU numbering system) to form the 'knob' in the second half-life extension moiety. These modified sequences have SEQ ID NOs 8 and 11 shown below:

First half-life extension moiety (Y349C; T366S; L38A; and Y407V) SEQ ID NO 8:

DKTHTCPPCPAPELLGGPSVFLFPPKPKDTLMISRTPEVTCVVVDVSHE

DPEVKFNWYVDGVEVHNAKTKPREEQYNSTYRVVSVLTVLHQDWL

NGKEYKCKVSNKALPAPIEKTISKAKGQPREPQVCTLPPSRDELTKNQ

VSLSCAVKGFYPSDIAVEWESNGQPENNYKTTPPVLDSDGSFFLVSKL

TVDKSRWQQGNVFSCSVMHEALHNHYTQKSLSLSPG

Second half-life extension moiety (S354C and T366W) SEQ ID NO 11:

DKTHTCPPCPAPELLGGPSVFLFPKPKDTLMISRTPEVTCVVVDVSH

EDPEVKFWYVDGVEVHNKTKPREEQYNSTYRVVSVLTVLHQDW

LVGKEYKCKVSNKALPAPIEKTISKAKGQPREPQVYTLPPCRDELTK

NQVSLWCLVKGFYPSDIAVEWESNGQPENNYKTTPPVLDSDGSFFL

YSKLTVDKSRWQQGNVFSCSVMHEALHNHYTQKSLSLSPG

In some embodiments, the first and second half-life extension moieties each further comprise amino substitution N297A, numbered according to the Kabat EU numbering system:

First half-life extension moiety (Y349C; T366S; L38A; Y407V and N297A) SEQ ID NO 9:

DKTHTCPPCPAPELLGGPSVFLFPPKPKDTLMISRTPEVTCVVVDVSHE

DPEVKFNWYVDGVEVHNAKTKPREEQYASTYRVVSVLTVLHQDWL

NGKEYKCKVSNKALPAPIEKTISKAKGQPREPQVCTLPPSRDELTKNQ

VSLSCAVKGFYPSDIAVEWESNGQPENNYKTTPPVLDSDGSFFLVSKL

TVDKSRWQQGNVFSCSVMHEALHNHYTQKSLSLSPG

Second half-life extension moiety (S354C, T366W and N297A) SEQ ID NO 12:

DKTHTCPPCPAPELLGGPSVFLFPPKPKDTLMISRTPEVTCVVVDVSH

EDPEVKFNWYVDGVEVHNAKTKPREEQYASTYRVVSVLTVLHQDW

LNGKEYKCKVSNKALPAPIEKTISKAKGQPREPQVYTLPPCRDELTK

NQVSLWCLVKGFYPSDIAVEWESNGQPENNYKTTPPVLDSDGSFFL

YSKLTVDKSRWQQGNVFSCSVMHEALHNHYTQKSLSLSPG

In some embodiments, the first and second half-life extension moieties each further comprise the amino substitution I253A, numbered according to the Kabat EU numbering system.

In some embodiments, the first and second half-life extension moieties each further comprise both the amino substitutions N297A and I253A, numbered according to the Kabat EU numbering system:

First half-life extension moiety (Y349C; T366S; L38A; Y407V, N297A and I253A) SEQ ID NO 10:

DKTHTCPPCPAPELLGGPSVFLFPPKPKDTLMASRTPEVTCVVVDVSHED

PEVKFNWYVDGVEVHNAKTKPREEQYASTYRVVSVLTVLHQDWLNGKE

YKCKVSNKALPAPIEKTISKAKGQPREPQVCTLPPSRDELTKNQVSLSCA

VKGFYPSDIAVEWESNGQPENNYKTTPPVLDSDGSFFLVSKLTVDKSRW

QQGNVFSCSVMHEALHNHYTQKSLSLSPG

Second half-life extension moiety (S354C, T366W, N297A and I253A) SEQ ID NO 13:

DKTHTCPPCPAPELLGGPSVFLFPPKPKDTLMASRTPEVTCVVVDVSHED

PEVKFNWYVDGVEVHNAKTKPREEQYASTYRVVSVLTVLHQDWLNGKEY

KCKVSNKALPAPIEKTISKAKGQPREPQVYTLPPCRDELTKNQVSLWCLV

KGFYPSDIAVEWESNGQPENNYKTTPPVLDSDGSFFLYSKLTVDKSRW

QQGNVFSCSVMHEALHNHYTQKSLSLSPG

In some embodiments, the first half-life extension moiety comprises an amino acid sequence having about or at least about 85%, 86%, 87%, 88%, 89%, 90%, 91%, 92%, 93%, 94%, 95%, 96%, 97%, 98%, or 99% sequence identity to any one of the amino acid sequence of any one of SEQ ID NOs: 7, 8, 9 and 10.

In some embodiments, the second half-life extension moiety comprises an amino acid sequence having about or at least about 85%, 86%, 87%, 88%, 89%, 90%, 91%, 92%, 93%, 94%, 95%, 96%, 97%, 98%, or 99% sequence identity to any one of the amino acid sequence of any one of SEQ ID NOs: 7, 11, 12 and 13.

In some embodiments, the first half-life extension moiety comprises an amino acid sequence having one or more modifications, such as one or more amino acid substitutions, additions, or deletions, as compared to the amino acid sequence of any one of SEQ ID NOs: 7, 8, 9 and 10. In some embodiments, the second half-life extension moiety comprises an amino acid sequence having one or more modifications, such as one or more amino acid substitutions, additions, or deletions, as compared to the amino acid sequence of any one of SEQ ID NOs: 7, 11, 12 and 13. The one or more modifications can be any modifications or alterations described herein, including, in some embodiments, any modifications or alterations disclosed herein that promote heterodimerization of polypeptide chains and/or suppresses homodimerization of polypeptide chains, alter effector function, or enhance effector function.

In some embodiments, the Fc domain or fragment thereof comprises one or more amino acid substitutions altering effector function. In some embodiments, the half-life extension moiety is an IgG1 Fc domain or fragment thereof and comprises one or more amino acid substitutions selected from the group consisting of N297A, N297G, N297Q, L234A, L235A, C220S, C226S, C229S, P238S, E233P, L234V, L234F, L235E, P331S, S267E, L328F, D265A, and P329G, numbered according to the Kabat EU numbering system. In some embodiments, the half-life extension moiety is an IgG2 Fc domain or fragment thereof and comprises the amino substitution(s): V234A and G237A; H268Q, V309L, A330S, and A331S; and/or V234A, G237A, P238S, H268A, V309L, and A330S, numbered according to the Kabat EU numbering system. In some embodiments, the half-life extension moiety is an IgG2 Fc domain or fragment thereof and comprises one or more amino acid substitutions selected from the group consisting of V234A, G237A, H268Q, V309L, A330S, A331S, P238S, H268A, and V309L, numbered according to the Kabat EU numbering system. In some embodiments, the half-life extension moiety is an IgG4 Fc domain or fragment thereof and comprises the amino substitution(s): L235A, G237A, and E318A; S228P, L234A, and L235A; H268Q, V309L, A330S, and P331S; and/or S228P and L235A, numbered according to the Kabat EU numbering system. In some embodiments, the half-life extension moiety is an IgG2 Fc domain or fragment thereof and comprises one or more amino acid substitutions selected from the group consisting of L235A, G237A, E318A, S228P, L234A, H268Q, V309L, A330S, and P331S, numbered according to the Kabat EU numbering system.

In some embodiments, the half-life extension moiety comprises Fc domain or fragment thereof that comprises one or more amino acid substitutions enhancing effector function. In some embodiments, the half-life extension moiety is an IgG1 Fc domain or fragment thereof and comprises the amino acid substitution(s): S298A, E333A, and K334A; S239D and I332E; S239D, A330L, and I332E; P247I and A339D or A339Q; D280H and K290S; D280H, K290S, and either S298D or S298V; F243L, R292P, and Y300L; F243L, R292P, Y300L, and P396L; F243L, R292P, Y300L, V305L, and P396L; G236A, S239D, and I332E; K326A and E333A; K326W and E333S; K290E, S298G, and T299A; K290E, S298G, T299A, and K326E; K290N, S298G, and T299A; K290N, S298G, T299A, and K326E; K334V; L235S, S239D, and K334V; K334V and Q331M, S239D, F243V, E294L, or S298T; E233L, Q311M, and K334V; L234I, Q311M, and K334V; K334V and S298T, A330M, or A330F; K334V, Q311M, and either A330M or A330F; K334V, S298T, and either A330M or A330F; K334V, S239D, and either A330M or S298T; L234Y, Y296W, and K290Y, F243V, or E294L; Y296W and either L234Y or K290Y; S239D, A330S, and I332E, V264I; F243L and V264I; L328M; I332E; L328M and I332E; V264I and I332E; S239E and I332E; S239Q and I332E; S239E; A330Y; I332D; L328I and I332E; L328Q and I332E; V264T; V240I; V266I; S239D; S239D and I332D; S239D and I332N; S239D and I332Q; S239E and I332D; S239E and I332N; S239E and I332Q; S239N and I332D; S239N and I332E; S239Q and I332D; A330Y and I332E; V264I, A330Y, and I332E; V264I, A330L, and I332E; L234E, L234Y, or L234I; L235D, L235S, L235Y, or L235I; S239T; V240M; V264Y; A330I; N325T; I332E and L328D, L328V, L328T, or L328I; V264I, I332E, and either S239E or S239Q; S239E, V264I, A330Y, and I332E; A330Y, I332E, and either S239D or S239N; A330L, I332E, and either S239D or S239N; V264I, S298A, and I332E; S298A, I332E, and either S239D or S239N; S239D, V264I, and I332E; S239D, V264I, S298A, and I332E; S239D, V264I, A330L, and I332E; S239D, I332E, and A330I; P230A; P230A, E233D, and I332E; E272Y; K274T, K274E, K274R, K274L, or K274Y; F275W; N276L; Y278T; V302I; E318R; S324D, S324I or S324V; K326I or K326T; T335D, T335R, or T335Y; V240I and V266I; S239D, A330Y, I332E, and L234I; S239D, A330Y, I332E, and L235D; S239D, A330Y, I332E, and V240I; S239D, A330Y, I332E, and V264T; and/or S239D, A330Y, I332E, and either K326E or K326T, numbered according to the Kabat EU numbering system. In some embodiments, the half-life extension moiety is an IgG1 Fc domain or fragment thereof and comprises one or more amino acid substitution (s) selected from the group consisting of: P230A, E233D, L234E, L234Y, L234I, L235D, L235S, L235Y, L235I, S239D, S239E, S239N, S239Q, S239T, V240I, V240M, F243L, V264I, V264T, V264Y, V266I, E272Y, K274T, K274E, K274R, K274L, K274Y, F275W, N276L, Y278T, V302I, E318R, S324D, S324I, S324V, N325T, K326I, K326T, L328M, L328I, L328Q, L328D, L328V, L328T, A330Y, A330L, A330I, I332D, I332E, I332N, I332Q, T335D, T335R, and T335Y.

In some embodiments, the half-life extension moiety comprises one or more amino acid substitution(s) that enhance binding of the half-life extension moiety to FcRn. In some embodiments, the one or more amino acid substitution(s) increase binding affinity of an Fc-containing polypeptide (e.g., a heavy chain polypeptide or an Fc domain or fragment thereof) to FcRn at acidic pH. In some embodiments, the half-life extension moiety comprises one or more amino acid substitution(s) selected from the group consisting of M428F; T250Q and M428F; M252Y, S254T, and T256E; P257I and N434H; D376V and N434H; P257I and Q311I; N434A; N434W; M428F and N434S; V259I and V308F; M252Y, S254T, and T256E; V259I, V308F and M428F; T307Q and N434A; T307Q and N434S; T307Q, E380A, and N434A; V308P and N434A; N434H; and V308P.

For manufacturing purposes, a signal peptide may be engineered upstream of the half life domain to improve secretion of the protein. The signal peptide is selected according to the cell line's requirements as is known in the art. It will be understood that the signal peptide is not expressed as part of the protein that will be purified and formulated as drug product.

1.1.1 Heterodimerization Modifications

The half-life extension moieties described herein may include one or more modifications that promote heterodimerization of two different half-life extension moieties. In some embodiments, it is desirable to promote heterodimerization of the first and second half-life extension moieties such that production of the drug construct in its correct heterodimeric form is produced efficiently. As such, one or more amino acid modifications can be made to the first half-life extension moiety and one or more amino acid modifications can be made to the second half-life extension moiety using any strategy available in the art, including any strategy as described in Klein et al. (2012), MAbs, 4(6): 653-663. Exemplary strategies and modifications are described in detail below.

1.1.2 Knobs-into-Holes Approach

One strategy for promoting heterodimerization of two different half-life extension moieties is an approach termed the "knobs-into-holes".

In some embodiments, the drug construct comprises a first half-life extension moiety and a second half-life extension moiety, each of which comprises a CH3 domain. In some embodiments, the half-life extension moiety comprising a CH3 domain is a heavy chain polypeptide or a fragment thereof (e.g., an Fc domain or fragment thereof). The CH3 domains of the two half-life extension moieties can be altered by the "knobs-into-holes" technology, which is described in detail with several examples in, e.g., WO 1996/027011; Ridgway, J. B. et al, Protein Eng. (1996) 9(7): 617-621; Merchant, A. M., et al, Nat. Biotechnol. (1998) 16(7): 677-681. See also Klein et al. (2012), MAbs, 4(6): 653-663. Using the knob-into-holes method, the interaction surfaces of the two CH3 domains are altered to increase the heterodimerization of the two half-life extension moieties containing the two altered CH3 domains. This occurs by introducing a bulky residue into the CH3 domain of one of the half-life extension moieties, which acts as the "knob." Then, in order to accommodate the bulky residue, a "hole" is formed in the other half-life extension moiety that can accommodate the knob. Either of the altered CH3 domains can be the "knob" while the other can be the "hole." The introduction of a disulfide bridge further stabilizes the heterodimers (Merchant, A. M., et al, Nat. Biotechnol. (1998) 16(7); Atwell, S., et al, J. Mol. Biol. (1997) 270(1): 26-35) as well as increases yield.

It has been reported that heterodimerization yields above 97% can be achieved by introducing the S354C and T366W mutations in a heavy chain to create the "knob" and by introducing the Y349C, T366S, L368A, and Y407V mutations in a heavy chain to create the "hole" (numbering of the residues according to the Kabat EU numbering system). Carter et al. (2001), J. Immunol. Methods, 248: 7-15; Klein et al. (2012), MAbs, 4(6): 653-663.

In some embodiments comprising a first half-life extension moiety and a second half-life extension moiety, the first half-life extension moiety comprises a heavy chain polypeptide or portion thereof (e.g., an Fc domain or fragment thereof) that comprises the amino acid mutations S354C and T366W (numbered according to the Kabat EU numbering system), and the second half-life extension moiety comprises a heavy chain polypeptide or portion thereof (e.g., an Fc domain or fragment thereof) that comprises the amino acid mutations Y349C, T366S, L368A, and Y407V (numbered according to the Kabat EU numbering system). In some embodiments comprising a first half-life extension moiety and a second half-life extension moiety, the first half-life extension moiety comprises a heavy chain polypeptide or portion thereof (e.g., an Fc domain or fragment thereof) that comprises the amino acid mutations Y349C, T366S, L368A, and Y407V (numbered according to the Kabat EU numbering system), and the second half-life extension moiety comprises a heavy chain polypeptide or portion thereof (e.g., an Fc domain or fragment thereof) that comprises the amino acid mutations S354C and T366W (numbered according to the Kabat EU numbering system).

Additional examples of substitutions that can be made to form knobs and holes include those described in US20140302037A1, the contents of which are herein incorporated by reference. For example, in some embodiments, any of the following amino acid substitutions can be made to a first half-life extension moiety ("first domain") and a paired second half-life extension moiety ("second domain") that each contain an Fc domain: (a) Y407T in the first domain and T366Y in the second domain; (b) Y407A in the first domain and T366W in the second domain; (c) F405A in the first domain and T394W in the second domain; (d) F405W in the first domain and T394S in the second domain; (e) Y407T in the first domain and T366Y in the second domain; (f) T366Y and F405A in the first domain and T394W and Y407T in the second domain; (g) T366W and F405W in the first domain and T394S and Y407A in the second domain; (h) F405W and Y407A in the first domain and T366W and T394S in the second domain; or (i) T366W in the first domain and T366S, L368A, and Y407V in the second domain, numbered according to the Kabat EU numbering system.

In some embodiments, any of the following amino acid substitutions can be made to a first half-life extension moiety ("first domain") and a paired second half-life extension moiety ("second domain") that each contain an Fc domain: (a) Y407T in the second domain and T366Y in the first domain; (b) Y407A in the second domain and T366W in the first domain; (c) F405A in the second domain and T394W in the first domain; (d) F405W in the second domain and T394S in the first domain; (e) Y407T in the second domain and T366Y in the first domain; (f) T366Y and F405A in the second domain and T394W and Y407T in the first domain; (g) T366W and F405W in the second domain and T394S and Y407A in the first domain; (h) F405W and Y407A in the second domain and T366W and T394S in the first domain; or (i) T366W in the second domain and T366S, L368A, and Y407V in the first domain, numbered according to the Kabat EU numbering system.

In embodiments comprising a first half-life extension moiety and a second half-life extension moiety that each comprise an Fc domain, any of the heterodimerizing alterations described herein can be used in the Fc domains to promote heterodimerization of any of the drug constructs described herein.

Therapeutic Moieties

Provided herein, in some embodiments, is a cytokine prodrug where the therapeutic moiety is a cytokine moiety. The masking moiety in the cytokine prodrug may comprise a domain of the extracellular domain of the cytokine receptor. The cytokine prodrug thus may be considered to be a masked cytokine.

The cytokine moiety may comprise a wild-type cytokine moiety or variant cytokine moiety.

Cytokines exemplified herein are IL-2, IL-12 and IL-15.

Cytokine Prodrugs

Cytokines play a role in cellular signalling, particularly in cells of the immune system. Provided herein is a cytokine moiety comprising a cytokine (e.g., IL-2, IL-15 or IL-12 cytokine) or functional fragment thereof for use in a masked cytokine or cleavage product thereof.

1.1 'Heteromdimeric' Masked Cytokines

Provided herein, in some embodiments, is a masked cytokine comprising a masking moiety in a first polypeptide chain and a cytokine moiety thereof in a second polypeptide chain. Such masked cytokines may be referred to as 'heterodimeric' masked cytokines.

In some embodiments, the masked cytokine comprises a protein heterodimer comprising:
  c) a first polypeptide chain comprising a masking moiety linked to a first half-life extension moiety via a first linker; and
  d) a second polypeptide chain comprising a cytokine moiety thereof linked to a second half-life extension moiety via a second linker,
wherein the first half-life extension moiety is associated with the second half-life extension moiety, and wherein at least the first linker or the second linker is a proteolytically cleavable peptide linker comprising a proteolytically cleavable peptide (CP) consisting of the amino acid sequence DLLAVVAAS (SEQ ID NO: 248) or ISSGLLSGRS (SEQ ID NO: 249).

In some embodiments, the first linker is a proteolytically cleavable peptide linker comprising a proteolytically cleavable peptide (CP) consisting of the amino acid sequence DLLAVVAAS (SEQ ID NO: 248) or ISSGLLSGRS (SEQ ID NO: 249). The proteolytically cleavable peptide linker may be as described anywhere herein. In some embodiments, the first linker is a proteolytically cleavable peptide linker comprising a proteolytically cleavable peptide (CP) consisting of the amino acid sequence DLLAVVAAS (SEQ ID NO: 248). In some embodiments, the first linker is a proteolytically cleavable peptide linker comprising a proteolytically cleavable peptide (CP) consisting of the amino acid sequence ISSGLLSGRS (SEQ ID NO: 249). In some embodiments, the first linker is a proteolytically cleavable peptide linker and the second linker is a non-cleavable linker. non-cleavable linker may be as described anywhere herein.

In some embodiments, the second linker is a proteolytically cleavable peptide linker comprising a proteolytically cleavable peptide (CP) consisting of the amino acid sequence DLLAVVAAS (SEQ ID NO: 248) or ISSGLLS-GRS (SEQ ID NO: 249). The proteolytically cleavable peptide linker may be as described anywhere herein. In some embodiments, the second linker is a proteolytically cleavable peptide linker comprising a proteolytically cleavable peptide (CP) consisting of the amino acid sequence DLLAVVAAS (SEQ ID NO: 248). In some embodiments, the second linker is a proteolytically cleavable peptide linker comprising a proteolytically cleavable peptide (CP) consisting of the amino acid sequence ISSGLLSGRS (SEQ ID NO: 249). In some embodiments, the second linker is a proteolytically cleavable peptide linker and the first linker is non-cleavable. The non-cleavable linker may be as described anywhere herein.

The proteolytically cleavable peptide linker may be as described anywhere herein.

The half-life extension moieties may be as described anywhere herein.

The combination of masking moiety and cytokine moiety may be as described anywhere herein.

In some embodiments, in the first polypeptide chain, the first half life extension domain is linked to the amino terminus of the first linker and the carboxy terminus of the first linker is linked to the amino terminus of the masking moiety and, in the second polypeptide chain, the second half life extension domain is linked to the amino terminus of the second linker and the carboxy terminus of the second linker is linked to the amino terminus of the cytokine moiety thereof.

In some embodiments, the first polypeptide chain comprises:

N'HL1-L1-MM C' and the second polypeptide chain comprises:

N'HL2-L2-C C' where HL1 is the first half life extension domain, L1 is the first linker, MM is the masking moiety, HL2 is the second half life extension domain, L2 is the second linker, and C is the cytokine moiety thereof.

In some embodiments, the second linker is the proteolytically cleavable linker and the first linker is a non-cleavable linker. This arrangement is described herein as 'Structure A'. In some embodiments, the first polypeptide chain comprises:

N'HL1-non-cleavable L1-MM C' and the second polypeptide chain comprises:

N'HL2-cleavable L2-C C'

In some embodiments, the first linker is the proteolytically cleavable linker and the second is a non-cleavable linker. This arrangement is described herein as 'Structure B'. In some embodiments, the first polypeptide chain comprises:

N'HL1-cleavable L1-MM C' and the second polypeptide chain comprises:

N'HL2-non-cleavable L2-C C'

1.2 'Linear' Masked Cytokines

Provided herein, in some embodiments, is a masked cytokine comprising a masking moiety and a cytokine moiety thereof linked in a single polypeptide chain. In some embodiments, the masked cytokine comprises a polypeptide chain comprising formula:

N'HL-L2-C-L1-MM C' where HL is the half life extension domain, L1 is the first linker, MM is the masking moiety, L2 is the second linker, and C is the cytokine moiety thereof, wherein at least the first linker comprises a proteolytically cleavable peptide.

In some embodiments, the masked cytokine comprises a polypeptide chain comprising formula:

N'HL-L2-MM-L1-C C' where HL is the half life extension domain, L1 is the first linker, MM is the masking moiety, L2 is the second linker, and C is the cytokine moiety thereof, wherein at least the first linker comprises a proteolytically cleavable peptide. In some embodiments, the first linker is a cleavable linker as described anywhere herein. In some embodiments, the second linker is a non-cleavable linker as described anywhere herein. In some embodiments, the cytokine moiety thereof is as described anywhere herein. In some embodiments, the half life extension domain (HL) comprises an Fc region of an antibody (i.e. the C-terminal region of an immunoglobulin heavy chain) or a fragment thereof comprising dimerized Fc domains (HL1-HL2). Although the boundaries of the Fc region of an immunoglobulin heavy chain might vary, the human IgG heavy-chain Fc region is usually defined to stretch from an amino acid residue at position Cys226, or from Pro230, to the carboxyl-terminus thereof. In some embodiments, the dimerized Fc domains of an antibody (HL1-HL2) comprises a first half life extension domain and a second half life extension domain as described anywhere herein, where the first half-life extension moiety comprises a first Fc domain or a fragment thereof and the second half-life extension moiety comprises a second Fc domain or a fragment thereof. In some embodiments, HL2 is a component of the polypeptide chain and HL1 is dimerized to HL2.

Cytokine Moieties and Masking Moieities

The cytokine moieties and masking moieties (e.g. IL-2, IL-12, and I1-15 cytokine moieties and masking moieties) disclosed herein may be used in any polypeptide drug construct disclosed herein.

The cytokine moieties and masking moieties disclosed herein may be used in a heterodimeric masked cytokine of Structure A as disclosed herein.

The cytokine moieties and masking moieties disclosed herein may be used in a heterodimeric masked cytokine of Structure B as disclosed herein.

The cytokine moieties and masking moieties disclosed herein may be used in a linear masked cytokine as disclosed herein.

1.2.1 IL-2 Cytokine Moieties and IL-2 Masking Moieties (a) IL-2 Cytokine Moieties In some embodiments, the therapeutic moiety comprises an IL-2 cytokine or functional fragment thereof.

IL-2 is an interleukin, which is a type of cytokine signalling molecule in the immune system that regulates activities of white blood cells.

In eukaryotic cells, naturally occurring IL-2 is synthesized as a precursor polypeptide of 153 amino acids, which has SEQ ID NO: 1. This is then processed into mature IL-2 by the removal of amino acid residues 1-20. This results in a mature form of IL-2 consisting of 133 amino acids (amino acid residues 21-153), which has SEQ ID NO: 2. "Functional fragments" of an IL-2 cytokine comprise a portion of a full length cytokine protein which retains or has modified cytokine receptor binding capability (e.g., within at least 50%, 80%, 90%, 95%, 96%, 97%, 98%, 99% or 100% activity compared to the full length cytokine protein). Cytokine receptor binding capability can be shown, for example, by the capability of a cytokine to bind to the cytokine's cognate receptor or a component thereof (e.g., one or more chain(s) of a heterotrimeric receptor complex).

In some embodiments, the IL-2 cytokine or functional fragment thereof is any naturally occurring interleukin-2 (IL-2) protein or modified variant thereof capable of binding to an interleukin-2 receptor, particularly the IL-2Rα chain. In the context of IL-2 cytokine binding, the target protein could be IL-2R (comprising the IL-2Rα, IL-2Rβ, and IL-2Rα chains), the IL-2Rα chain, the IL-2Rβ chain, or the IL-2Rα/β dimeric complex. In some embodiments, the IL-2 cytokine or functional fragment thereof comprises the amino acid sequence of amino acid residues 21-153 of SEQ ID NO: 1. In some embodiments, the IL-2 polypeptide or functional fragment thereof comprises the amino acid sequence of mature IL-2, SEQ ID NO: 2.

In some embodiments, the IL-2 cytokine or functional fragment thereof comprises an amino acid sequence having at least one amino acid modification as compared to the amino acid sequence of SEQ ID NO: 2. Each of the at least one amino acid modifications can be any amino acid modification, such as a substitution, insertion, or deletion. In some embodiments, the IL-2 cytokine or functional fragment thereof comprises an amino acid sequence having at least 1, at least 2, at least 3, at least 4, at least 5, at least 6, at least 7, at least 8, at least 9, or at least 10 amino acid substitutions as compared to the amino acid sequence of SEQ ID NO: 2. In some embodiments, the IL-2 cytokine or functional fragment thereof comprises an amino acid sequence having at least 5 amino acid substitutions as compared to the amino acid sequence of SEQ ID NO: 2.

In some embodiments, the IL-2 cytokine or functional fragment thereof comprises an amino acid sequence having one or more amino acid substitutions as compared to the amino acid sequence of wild-type IL-2 of SEQ ID NO: 2 that reduces the affinity of the IL-2 peptide or functional fragment thereof for IL-2Rα (CD25). In some embodiments, the IL-2 cytokine or functional fragment thereof comprises an amino acid sequence having one or more amino acid substitutions as compared to the amino acid sequence of SEQ ID NOs: 2, such that one or more of amino acid residues 38, 42, 45, and 62 is an alanine (A). In some embodiments, the IL-2 cytokine or functional fragment thereof comprises an amino acid sequence having one or more amino acid substitutions as compared to the amino acid sequence of SEQ ID NO: 2, such that amino acid residues 38, 42, 45, and 62 are an alanine (A).

In some embodiments, the IL-2 cytokine or functional fragment thereof comprises amino acid sequence substitution C125A as compared to the amino acid sequence of SEQ ID NOs: 2.

In some embodiments, the IL-2 cytokine or functional fragment thereof comprises an amino acid sequence having one or more amino acid substitutions as compared to the amino acid sequence of SEQ ID NO: 2, such that amino acid residues 38, 42, 45, and 62 are an alanine (A) and amino acid residue 125 is a alanine (A). In some embodiments, the IL-2 cytokine or functional fragment thereof comprises an amino acid sequence having amino acid residues R38, F42, Y45, and E62 substituted for alanine in the amino acid sequence of SEQ ID NO: 2. In some embodiments, the IL-2 cytokine or functional fragment thereof comprises an amino acid sequence having amino acid residues R38, F42, Y45, and E62 substituted for alanine (A) and amino acid residue C125 substituted for alanine (A) in the amino acid sequence of SEQ ID NO: 2.

In some embodiments, the IL-2 cytokine or functional fragment thereof comprises the amino acid sequence of SEQ ID NO: 3. In some embodiments, the IL-2 cytokine or functional fragment thereof comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 3.

In some embodiments, the IL-2 cytokine or functional fragment thereof has one or more amino acid residues e.g. residues 1-3 s removed as compared to the amino acid sequence of the mature IL-2 of SEQ ID 2, for the purpose of removing an O-glycosylation site. In some embodiments, the IL-2 cytokine or functional fragment thereof has one or more amino acid residues substituted as compared to the amino acid sequence of the mature IL-2 of SEQ ID 2, for the purpose of removing an O-glycosylation site. In some embodiments, the IL-2 cytokine or functional fragment thereof has one or more amino acid residues inserted, e.g. in the region of residues 1-3, as compared to the amino acid sequence of the mature IL-2 of SEQ ID 2, for the purpose of removing an O-glycosylation site. In some embodiments, the IL-2 cytokine or functional fragment thereof does not have an O-glycosylation site within residues 1-3.

(b) IL-2 Masking Moieties

Provided herein is a masking moiety for use in masking a therapeutic moiety comprising an IL-2 cytokine or functional fragment thereof.

It will be understood that the masking moiety is cleaved from the masked cytokine to form the cleavage product thereof. The masking moiety masks the IL-2 cytokine or functional fragment thereof in the masked cytokine thereby reducing or preventing binding of the IL-cytokine or functional fragment thereof to its cognate receptor. In some embodiments, the masking moiety reduces or prevents binding of the IL-2 cytokine or functional fragment thereof to IL-2Rα (CD25). In some embodiments, the masking moiety as provided herein refers to a moiety capable of binding to, or otherwise exhibiting an affinity for the IL-2 cytokine or functional fragment thereof, such as an anti-IL-2 antibody or IL-2 cognate receptor protein. Methods for determining the extent of binding of a protein (e.g., cytokine) to a cognate protein (e.g., cytokine receptor) are well known in the art.

In some embodiments, the masking moiety comprises an IL-2 cytokine receptor, or a subunit or functional fragment thereof.

In some embodiments, the masking moiety comprises IL-2Rβ (also referred to as CD122) or a fragment, portion, or variant thereof that retains or otherwise demonstrates an affinity to IL-2.

In some embodiments, the masking moiety comprises the amino acid sequence of SEQ ID NO: 4. In some embodiments, the masking moiety comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 4. In some embodiments, the masking moiety comprises an amino acid sequence having the amino acid sequence of SEQ ID NO: 4 with one to four amino acid substitutions.

In some embodiments, the masking moiety comprises an amino acid sequence having the amino acid sequence of SEQ ID NO: 4 with one or two amino acid substitutions.

In some embodiments, the IL-2Rβ or a fragment, portion or variant thereof has mutation at amino acid position C122 as compared to IL-2Rβ of SEQ ID NO: 4.

In some embodiments, the IL-2Rβ or a fragment, portion or variant thereof has mutation C122S at amino acid position 122 as compared to IL-2Rβ of SEQ ID NO: 4.

In some embodiments, the masking moiety comprises an amino acid sequence of SEQ ID NO: 4 with a C122 mutation.

In some embodiments, the masking moiety comprises an amino acid sequence of SEQ ID NO: 4 with a C122S mutation.

In some embodiments, the IL-2Rβ or a fragment, portion or variant thereof has mutation at amino acid position C168 as compared to IL-2Rβ of SEQ ID NO: 4.

In some embodiments, the IL-2Rβ or a fragment, portion or variant thereof has mutation C168S at amino acid position 168 as compared to IL-2Rβ of SEQ ID NO: 4.

In some embodiments, the masking moiety comprises an amino acid sequence of SEQ ID NO: 4 with a C168 mutation.

In some embodiments, the masking moiety comprises an amino acid sequence of SEQ ID NO: 4 with a C168S mutation.

In some embodiments, the IL-2Rβ or a fragment, portion or variant thereof has mutation at amino acid positions C122 and C168 as compared to IL-2Rβ of SEQ ID NO: 4.

In some embodiments, the IL-2Rβ or a fragment, portion or variant thereof has mutation C122S and C168S as compared to IL-2Rβ of SEQ ID NO: 4.

In some embodiments, the masking moiety comprises an amino acid sequence of SEQ ID NO: 5.

In some embodiments, when (i) the masked cytokine is a Structure A heterodimeric masked cytokine and (ii) the cytokine moiety is an IL-2 cytokine moiety, then the proteolytically cleavable peptide linker does not have the amino acid sequence GGSGISSGLLSGRSSSGP (SEQ ID NO: 120) or GISSGLLSGRSSSGP (SEQ ID NO: 121).

1.2.2 IL-12 Cytokine Moieties and IL-12 Masking Moieties (a) IL-12 Cytokine Moieties In some embodiments, the therapeutic moiety comprises an IL-12 cytokine or functional fragment thereof.

IL-12 is an interleukin, which is a type of cytokine signalling molecule in the immune system that regulates activities of white blood cells.

Endogenous IL-12 exists as two distinct molecules IL-12 p40 and IL-12 p35, that dimerize in the cell during biosynthesis.

The full sequences of IL-12 p40 and IL-12 p35 are (pro-peptides cleaved off during biosynthesis are shown) in bold):

```
IL-12 p40 subunit:
MCHQQLVISWFSLVFLASPLVAIWELKKDVYVVELDWYPDAPGEMWLTC

DTPEEDGITVVTLDQSSEVLGSGKTLTIQVKEFGDAGQYTCHKGGEVLS

HSLLLLHKKEDGIWSTDILKDQKEPKNKTFLRCEAKNYSGRFTCWWLTT

ISTDLTFSVKSSRGSSDPQGVTCGAATLSAERVRGDNKEYEYSVECQED

SACPAAEESLPIEVMVDAVHKLKYENYTSSFFIRDIIKPDPPKNLQLKP

LKNSRQVEVSWEYPDTWSTPHSYFSLTFCVQVQGKSKREKKDRVFTDKT

SATVICRKNASISVRAQDRYYSSSWSEWASVPCS

IL-12 p35 subunit:
MCPARSLLLVATLVLLDHLSLARNLPVATPDPGMFPCLHHSQNLLRAVS

NMLQKARQTLEFYPCTSEEIDHEDITKDKTSTVEACLPLELTKNESCLN
```

```
-continued
SRETSFITNGSCLASRKTSFMMALCLSSIYEDLKMYQVEFKTMNAKLLM

DPKRQIFLDQNMLAVIDELMQALNFNSETVPQKSSLEEPDFYKTKIKLC

ILLHAFRIRAVTIDRVMSYLNAS
```

The mature forms are as follows:

```
IL-12 p40 subunit:
IWELKKDVYVVELDWYPDAPGEMVVLTCDTPEEDGITWTLDQSSEVLGS

GKTLTIQVKEFGDAGQYTCHKGGEVLSHSLLLLHKKEDGIWSTDILKDQ

KEPKNKTFLRCEAKNYSGRFTCWWLTTISTDLTFSVKSSRGSSDPQGVT

CGAATLSAERVRGDNKEYEYSVECQEDSACPAAEESLPIEVMVDAVHKL

KYENYTSSFFIRDIIKPDPPKNLQLKPLKNSRQVEVSWEYPDTWSTPHS

YFSLTFCVQVQGKSKREKKDRVFTDKTSATVICRKNASISVRAQDRYYS

SSWSEWASVPCS

IL-12 p35 subunit:
RNLPVATPDPGMFPCLHHSQNLLRAVSNMLQKARQTLEFYPCTSEEIDH

EDITKDKTSTVEACLPLELTKNESCLNSRETSFITNGSCLASRKTSFMM

ALCLSSIYEDLKMYQVEFKTMNAKLLMDPKRQIFLDQNMLAVIDELMQA

LNFNSETVPQKSSLEEPDFYKTKIKLCILLHAFRIRAVT1DRVMSYLNA

S
```

They are expressed as two chains that covalently dimerize during biosynthesis through a disulfide bound between the two subunits: Cysteine C199 of the p40 subunit associates with Cysteine C96 of the p35 subunit.

"Functional fragments" of an IL-12 cytokine comprise a portion of a full length cytokine protein which retains or has modified cytokine receptor binding capability (e.g., within at least 50%, 80%, 90%, 95%, 96%, 97%, 98%, 99% or 100% activity compared to the full length cytokine protein). Cytokine receptor binding capability can be shown, for example, by the capability of a cytokine to bind to the cytokine's cognate receptor or a component thereof.

In some embodiments, the IL-12 cytokine or functional fragment thereof is any naturally occurring interleukin-2 (IL-12) protein or modified variant thereof capable of binding to an interleukin-12 receptor.

In some embodiments, the IL-12 polypeptide or functional fragment thereof comprises an IL-12p40 polypeptide or functional fragment thereof covalently linked to an IL-12p35 polypeptide or functional fragment thereof.

The IL-12p40 polypeptide or functional fragment thereof may be attached to the first half life extension domain such that the first polypeptide chain comprises formula:

N'HL1-L1-MM C' and the second polypeptide chain comprises formula:

N'HL2-L2-[IL-12p40-linker-IL-12p35]C' where 'IL-12p40' is the IL-12p40 polypeptide or functional fragment thereof and 'IL-12p35' is the IL-12p35 polypeptide or functional fragment thereof.

In some embodiments, the IL-12p40 polypeptide comprises SEQ ID NO: 204 shown in the IL-12 Cytokine Moieties table below. In some embodiments, the IL-12p40 polypeptide comprises an amino acid sequence having at least one amino acid modification as compared to the amino acid sequence of SEQ ID NO: 204 shown in the IL-12 Cytokine Moieties table below. Each of the at least one amino acid modifications can be any amino acid modification, such as a substitution, insertion, or deletion. In some embodiments, the IL-12 cytokine or functional fragment thereof comprises an amino acid sequence having at least 1, at least 2, at least 3, at least 4, at least 5, at least 6, at least 7, at least 8, at least 9, or at least 10 amino acid substitutions as compared to the amino acid sequence of SEQ ID NO: 204 shown in the IL-12 Cytokine Moieties table below. In some embodiments, the IL-12 cytokine or functional fragment thereof comprises an amino acid sequence having at least 5 amino acid substitutions as compared to the amino acid sequence of SEQ ID NO: 204 shown in the IL-12 Cytokine Moieties table below.

The IL-12p40 polypeptide comprises a glycosaminoglycan (GAG)-binding domain (KSKREKKDRV (SEQ ID NO: 117)). GAGs, such as heparin and heparan sulphate, have been shown to bind numerous growth factors and cytokines, including IL-12. The physiological significance of this binding is two-fold. First, GAGs can serve as co-receptors on cell surfaces to maintain high, local concentrations of cytokines. Second, GAGs can regulate bioactivities of growth factors and cytokines through multiple mechanisms including dimerization and protection from proteolytic degradation.

The GAG-binding domain in the mature form of the IL-12 p40 subunit is shown below in bold:

IWELKKDVYVVELDWYPDAPGEMWLTCDTPEEDGITWTLDQSSEVLGSG

KTLTIQVKEFGDAGQYTCHKGGEVLSHSLLLLHKKEDGIWSTDILKDQK

EPKNKTFLRCEAKNYSGRFTCWWLTTISTDLTFSVKSSRGSSDPQGVTC

GAATLSAERVRGDNKEYEYSVECQEDSACPAAEESLPIEVMVDAVHKLK

YENYTSSFFIRDIIKPDPPKNLQLKPLKNSRQVEVSWEYPDTWSTPHSY

FSLTFCVQVQGKSKREKKDRVFTDKTSATVICRKNASISVRAQDRYYSS

SWSEWASVPCS

Modifications to the GAG-binding domain (KSKREKKDRV (SEQ ID NO: 117)) has been shown herein to increase the PK profile of constructs comprising an IL-12 cytokine with a mutated GAG-binding domain, without any decrease in cytokine activity. Thus, in some embodiments, the IL-12p40 polypeptide comprises at least one amino acid modification to the GAG-binding domain. In some embodiments, the modification to the GAG-binding domain is a deletion mutation. In some embodiments, the modification to the GAG-binding domain is a deletion mutation and at least one substitution mutation.

In some embodiments, the GAG-binding domain comprises the amino acid sequence KDNTERV (SEQ ID NO: 126). In some embodiments, the IL-12p40 polypeptide comprises the amino acid sequence SEQ ID NO: 205 shown in the IL-12 Cytokine Moieties table below. In some embodiments, the GAG-binding domain comprises the amino acid sequence KDNTEGRV (SEQ ID NO: 127). In some embodiments, the IL-12p40 polypeptide comprises the amino acid sequence SEQ ID NO: 206 shown in the IL-12 Cytokine Moieties table below.

In some embodiments, the GAG-binding domain consists of the amino acid sequence KDNTERV (SEQ ID NO: 126). In some embodiments, the IL-12p40 polypeptide comprises the amino acid sequence SEQ ID NO: 205 shown in the IL-12 Cytokine Moieties table below. In some embodiments, the GAG-binding domain consists of the amino acid sequence KDNTEGRV (SEQ ID NO: 127). In some embodiments, the IL-12p40 polypeptide comprises the amino acid sequence SEQ ID NO: 206 shown in the IL-12 Cytokine Moieties table below.

In some embodiments, the IL-12p40 polypeptide comprises an amino acid sequence having one or more cysteine substitutions as compared to the amino acid sequence of SEQ ID NO: 204 shown in the IL-12 Cytokine Moieties table below. In some embodiments, the IL-12p40 polypeptide comprises an amino acid sequence having an amino acid substitution at position C252 as compared to the amino acid sequence of SEQ ID NO: 204 shown in the IL-12 Cytokine Moieties table below. In some embodiments, the amino acid substitution at position C252 is C252S. In some embodiments, the IL-12p40 polypeptide comprises an amino acid sequence of SEQ ID NO: 207 shown in the IL-12 Cytokine Moieties table below. In some embodiments, the IL-12p40 polypeptide comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 207 shown in the IL-12 Cytokine Moieties table below. In some embodiments, the IL-12p40 polypeptide consists of an amino acid sequence of SEQ ID NO: 207 shown in the IL-12 Cytokine Moieties table below.

In some embodiments, the IL-12p40 polypeptide comprises an amino acid sequence having one or more cysteine substitutions as compared to the amino acid sequence of SEQ ID NO: 204 shown in the IL-12 Cytokine Moieties table below, and at least one amino acid modification to the GAG-binding domain. In some embodiments, the IL-12p40 polypeptide comprises an amino acid substitution at position C252S as compared to the amino acid sequence of SEQ ID NO: 204 shown in the IL-12 Cytokine Moieties table below, and the GAG-binding domain comprises the amino acid sequence KDNTERV (SEQ ID NO: 126).

In some embodiments, the IL-12p40 polypeptide comprises an amino acid substitution at position C252S as compared to the amino acid sequence of SEQ ID NO: 204 shown in the IL-12 Cytokine Moieties table below, and the GAG-binding domain comprises the amino acid sequence KDNTEGRV (SEQ ID NO: 127). In some embodiments, the IL-12p40 polypeptide comprises an amino acid sequence of SEQ ID NO: 208 shown in the IL-12 Cytokine Moieties table below. In some embodiments, the IL-12p40 polypeptide comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 208 shown in the IL-12 Cytokine Moieties table below. In some embodiments, the IL-12p40 polypeptide consists of an amino acid sequence of SEQ ID NO: 208 shown in the IL-12 Cytokine Moieties table below.

In some embodiments, the IL-12p35 polypeptide comprises SEQ ID NO: 209 shown in the IL-12 Cytokine Moieties table below. In some embodiments, the IL-12p35 polypeptide comprises an amino acid sequence having at least one amino acid modification as compared to the amino acid sequence of SEQ ID NO: 209 shown in the IL-12 Cytokine Moieties table below. Each of the at least one amino acid modifications can be any amino acid modification, such as a substitution, insertion, or deletion. In some embodiments, the IL-12 cytokine or functional fragment thereof comprises an amino acid sequence having at least 1, at least 2, at least 3, at least 4, at least 5, at least 6, at least 7, at least 8, at least 9, or at least 10 amino acid substitutions as compared to the amino acid sequence of SEQ ID NO: 209 shown in the IL-12 Cytokine Moieties table below. In some embodiments, the IL-12 cytokine or functional fragment thereof comprises an amino acid sequence having at least 5 amino acid substitutions as compared to the amino acid sequence of SEQ ID NO: 209 shown in the IL-12 Cytokine Moieties table below.

In some embodiments, the IL-12p40-IL-12p35 linker is between 5 and 20 amino acids in length.

In some embodiments, the IL-12p40-IL-12p35 linker is rich in amino acid residues G and S.

In some embodiments, the IL-12p40-IL-12p35 linker only includes amino acid residue types selected from the group consisting of G and S.

In some embodiments, the IL-12p40-IL-12p35 linker includes [(G)$_n$S], where n=4 or 5 (SEQ ID NO: 435).

In some embodiments, the IL-12p40-IL-12p35 linker includes a (GGGGS (SEQ ID NO: 277)) repeat.

In some embodiments, IL-12p40-IL-12p35 linker comprises SEQ ID NO: 116. (GGGGSGGGGSGGGGS)

In some embodiments, the IL-12 cytokine or functional fragment thereof comprises SEQ ID NO: 210 shown in the IL-12 Cytokine Moieties table below. In some embodiments, the IL-12 cytokine or functional fragment thereof comprises an amino acid sequence having at least one amino acid modification as compared to the amino acid sequences of SEQ ID NO: 204 and 209 shown in the IL-12 Cytokine Moieties table below. Each of the at least one amino acid modifications can be any amino acid modification, such as a substitution, insertion, or deletion. In some embodiments, the IL-12 cytokine or functional fragment thereof comprises an amino acid sequence having at least 1, at least 2, at least 3, at least 4, at least 5, at least 6, at least 7, at least 8, at least 9, or at least 10 amino acid substitutions as compared to the amino acid sequences of SEQ ID NO: 204 and 209 shown in the IL-12 Cytokine Moieties table below. In some embodiments, the IL-12 cytokine or functional fragment thereof comprises an amino acid sequence having at least 5 amino acid substitutions as compared to the amino acid sequences of SEQ ID NO: 204 and 209 shown in the IL-12 Cytokine Moieties table below.

In some embodiments, the IL-12 cytokine or functional fragment thereof comprises the amino acid sequence of SEQ ID NO: 210 shown in the IL-12 Cytokine Moieties table below. In some embodiments, the IL-12 cytokine or functional fragment thereof comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 210 shown in the IL-12 Cytokine Moieties table below.

In some embodiments, the IL-12 cytokine or functional fragment thereof comprises the amino acid sequence of SEQ ID NO: 211 shown in the IL-12 Cytokine Moieties table below. In some embodiments, the IL-12 cytokine or functional fragment thereof comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 211 shown in the IL-12 Cytokine Moieties table below.

In some embodiments, the IL-12 cytokine or functional fragment thereof comprises the amino acid sequence of SEQ ID NO: 212. In some embodiments, the IL-12 cytokine or functional fragment thereof comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 212 shown in the IL-12 Cytokine Moieties table below.

In some embodiments, the IL-12 cytokine or functional fragment thereof comprises the amino acid sequence of SEQ ID NO: 213 shown in the IL-12 Cytokine Moieties table below. In some embodiments, the IL-12 cytokine or functional fragment thereof comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 213 shown in the IL-12 Cytokine Moieties table below.

In some embodiments, the IL-12 cytokine or functional fragment thereof comprises the amino acid sequence of SEQ ID NO: 214 shown in the IL-12 Cytokine Moieties table below. In some embodiments, the IL-12 cytokine or functional fragment thereof comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 214 shown in the IL-12 Cytokine Moieties table below.

TABLE

| | | | |
|---|---|---|---|
| IL-12 Cytokine Moieties: | | | |
| | Component | SEQ ID NO | Sequence |
| hIL12B | IL-12 p40 subunit | 204 | IWELKKDVYWELDWYPDAPGEMWLTCDTPEED GITWTLDQSSEVLGSGKTLTIQVKEFGD AGQYTCHKGGEVLSHSLLLLHKKEDGIWSTDILKD QKEPKNKTFLRCEAKNYSGRFTCWWLTTI STDLTFSVKSSRGSSDPQGVTCGAATLSAERVRGD NKEYEYSVECQEDSACPAAEESLPIEVMV DAVHKLKYENYTSSFFIRDIIKPDPPKNLQLKPLKNSR QVEVSWEYPDTWSTPHSYFSLTFCVQV QGKSKREKKDRVFTDKTSATVICR KNASISVRAQDRYYSSSWSEWASV PCS |
| | IL-12 p40 subunit [KDNTERV] IL-12 p40 subunit [KDNTEGRV] | 205 | IWELKKDVYVVELDWYPDAPGEMWLTCDTPEEDGITW TLDQSSEVLGSGKTLTIQVKEFGDAGQYTCHKGGEVL SHSLLLLHKKEDGIWSTDILKDQ KEPKNKTFLRCEAKNYSGRFTCWWLTTISTDLTFSVK SSRGSSDPQGVTCGAATLSAERV RGDNKEYEYSVECQEDSACPAAEESLPIEVMVDAVHK LKYENYTSSFFIRDIIKPDPPKN LQLKPLKNSRQVEVSWEYPDTWSTPHSYFSLTFCVQ VQGKDNTERVFTDKTSATVICRKNASISVRAQDRYY SSSWSEWASVPCS |

TABLE-continued

IL-12 Cytokine Moieties:

| | Component | SEQ ID NO | Sequence |
|---|---|---|---|
| | IL-12 p40 subunit {C252S} | 206 | IWELKKDVYVVELDWYPDAPGEMWLTCDTPEEDGITW TLDQSSEVLGSGKTLTIQVKEFGDAGQYTCHKGGEVLSH SLLLLHKKEDGIWSTDILKDQ KEPKNKTFLRCEAKNYSGRFTCWWLTTISTDLTFSVKSSR GSSDPQGVTCGAATLSAERV RGDNKEYEYSVECQEDSACPAAEESLPIEVMVDAVHKLK YENYTSSFFIRDIIKPDPPKN LQLKPLKNSRQVEVSWEYPDTWSTPHSYFSLTFCVQVQG KDNTEGRVFTDKTSATVICRKNASISVRAQDRYYSSSWS EWASVPCS |
| | | 207 | IWELKKDVYWELDWYPDAPGEMWLTCDTPEEDGITW TLDQSSEVLGSGKTLTIQVKEFGDAGQYTCHKGGEVLSHS LLLLHKKEDGIWSTDILKDQKEPKNTFLRCEAKNYSGRF TCWWLTTISTDLTFSVKSSRGSSDPQGVTCGAATLSAERV RGDNKEYEYSVECQEDSACPAAEESLPIEVMVDAVHKLK YENYTSSFFIRDIIKPDPPKNLQLKPLKNSRQVEVSWEYP DTWSTPHSYFSLTFSVQVQGKSKREKKDRVFTDKTSATV ICRKNASISVRAQDRYYSSSWSEWASVPCS |
| | p40 subunit [KDNTEGRV] + [C25S] | 208 | IWELKKDVYVVELDWYPDAPGEMVVLTCDTPEEDGITW TLDQSSEVLGSGKTLTIQVKEFGDAGQYTCHKGGEVLS HSLLLLHKKEDGIWSTDILKDQKEPKNKTFLRCEAKNYS GRFTCWWLTTISTDLTFSVKSSRGSSDPQGVTCGAATLS AERVRGDNKEYEYSVECQEDSACPAAEESLPIEVMVDA VHKLKYENYTSSFFIRDIIKPDPPKNLQLKPLKNSRQVEV SWEYPDTWSTPHSYFSLTFSVQVQGKDNTEGRVFTDKTS ATVICRKNASISVRAQDRYYSSSWSEWASVPCS |
| hIL12A | IL-12 p35 subunit | 209 | RNLPVATPDPGMFPCLHHSQNLLRAVSNMLQKARQTLE FYPCTSEEIDHEDITKDKTSTVEACLPLE LTKNESCLNSRETSF1TNGSCLASRKTSFMMALCLSSIYE DLKMYQVEFKTMNAKLLMDPKRQIFLDQ NMLAVIDELMQALNFNSETVPQKSSLEEPDFYKTKIKLCIL LHAFRIRAVTIDRVMSYLNAS |
| Cytokine | hIL12B-hIL12A | 210 | IWELKKDVYWELDWYPDAPGEMWLTCDTPEEDGIT WTLDQSSEVLGSGKTLTIQVKEFGD AGQYTCHKGGEVLSHSLLLLHKKEDGIWSTD1LKDQK EPKNKTFLRCEAKNYSGRFTCWWLT TISTDLTFSVKSSRGSSDPQGVTCGAATLSAERVRGDN KEYEYSVECQEDSACPAAEESLPIEV MVDAVHKLKYENYTSSFFIRDIIKPDPPKNLQLKPLKN SRQVEVSWEYPDTWSTPHSYFSLTF CVQVQGKSKREKKDRVFTDKTSATVICRKNASISVR AQDRYYSSSWSEWASVPCSGGGGS GGGGSGGGGSRNLPVATPDPGMFPCLHHSQNLLRAVS NMLQKARQTLEFYPCTSEEIDHE DITKDKTSTVEACLPLELTKNESCLNSRETSFITNGSCL ASRKTSFMMALCLSSIYEDLKMYQVE FKTMNAKLLMDPKRQIFLDQNMLAVIDELMQALNFNS ETVPQKSSLEEPDFYKTKIKLCILLHA FRIRAVTIDRVMSYLNAS |
| | hIL12B-hIL12A [KDNTERV] | 211 | IWELKKDVYVVELDWYPDAPGEMWLTCDTPEEDG ITWTLDQSSEVLGSGKTLTIQVKEFGD AGQYTCHKGGEVLSHSLLLLHKKEDGIWSTDILKDOK EPKNKTFLRCEAKNYSGRFTCWWLT TISTDLTFSVKSSRGSSDPQGVTCGAATLSAERVRGD NKEYEYSVECQEDSACPAAEESLPIEV MVDAVHKLKYENYTSSFFIRDIIKPDPPKNLQLKPLK NSRQVEVSWEYPDTWSTPHSYFSLTF CVQVQGKDNTERVFTDKTSATVICRKNASISVRAQD RYYSSSWSEWASVPCSGGGGS GGGGSGGGGSRNLPVATPDPGMFPCLHHSQNLLRAV SNMLQKARQTLEFYPCTSEEIDHE DITKDKTSTVEACLPLELTKNESCLNSRETSFITNGSC LASRKTSFMMALCLSSIYEDLKMYQVE FKTMNAKLLMDPKRQIFLDQNMLAVIDELMQALNF NSETVPQKSSLEEPDFYKTKIKLCILLHA FRIRAVTIDRVMSYLNAS |
| | hIL12B-hIL12A [KDNTEGRV] | 212 | IWELKKDVYVVELDWYPDAPGEMWLTCDTPEEDGI TWTLDQSSEVLGSGKTLTIQVKEFGD AGQYTCHKGGEVLSHSLLLLHKKEDGIWSTDILKDQK EPKNKTFLRCEAKNYSGRFTCWWLT TISTDLTFSVKSSRGSSDPQGVTCGAATLSAERVRGD NKEYEYSVECQEDSACPAAEESLPIEV MVDAVHKLKYENYTSSFFIRDIIKPDPPKNLQLKPLKN SRQVEVSWEYPDTWSTPHSYFSLTF |

TABLE-continued

IL-12 Cytokine Moieties:

| Component | SEQ ID NO | Sequence |
|---|---|---|
| hIL12B-hIL12A [C252S] | 213 | CVQVQGKDNTEGRVFTDKTSATVICRKNASISVRAQD RYYSSSWSEWASVPCSGGGGS GGGGSGGGGSRNLPVATPDPGMFPCLHHSQNLLRAV SNMLQKARQTLEFYPCTSEEIDHE DITKDKTSTVEACLPLELTKNESCLNSRETSFITNGSC LASRKTSFMMALCLSSIYEDLKMYQVE FKTMNAKLLMDPKRQIFLDQNMLAVIDELMQALNF NSETVPQKSSLEEPDFYKTKIKLCILLHA FRIRAVTIDRVMSYLNAS IWELKKDVYVVELDWYPDAPGEMWLTCDTPEEDGI TWTLDQSSEVLGSGKTLTIQVKEFGDAGQYTCHKGGE VLSHSLLLLHKKEDGIWSTDILKDQKEPKNKTFLRCE AKNYSGRFTCWWLTTISTDLTFSVKSSRGSSDPQGVT CGAATLSAERVRGDNKEYEYSVECQEDSACPAAEES LPIEVMVDAVHKLKYENYTSSFFIRDIIKPDPPKNLQL KPLKNSRQVEVSWEYPDTWSTPHSYFSLTFSVQVQG KSKREKKDRWTDKTSATVICRKNASISVRAQDRYYS SSWSEWASVPCSGGGGSGGGGSGGGGSRNLPVATPD PGMFPCLHHSQNLLRAVSNMLQKARQTLEFYPCTSE ETDHEDITKDKTSTVEACLPLELTKNESCLNSRETSFI TNGSCLASRKTSFMMALCLSSIYEDLKMYQVEFKTM NAKLLMDPKRQIFLDQNMLAVIDELMQALNFNSETV PQKSSLEEPDFYKTKIKLCILLHAFRIRAVTIDRVMSYLNAS |
| hIL12B-hIL12A [KDNTEGRV] + [C252S] | 214

-continued

*FVCKLACINSDEIQICGAEIFVGVAPEQPQNLSCIQKGEQGTVACTWER*

*GRDTHLYTEYTLQLSGPKNLTWQKQCKDIYCDYLDFGINLTPESPESNF*

*TAKVTAVNSLGSSSSLPSTFTFLDIVRPLPPWDIRIKFQKASVSRCTLY*

*WRDEGLVLLNRLRYRPSNSRLWNMVNVTKAKGRHDLLDLKPFTEYEFQI*

*SSKLHLYKGSWSDWSESLRAQTPEEEPTGMLDVWYMKRHIDYSRQQISL*

*FWKNLSVSEARGKILHYQVTLQELTGGKAMTQNITGHTSWTTVIPRTGN*

*WAVAVSAANSKGSSLPTRINIMNLCEAGLLAPRQVSANSEGMDNILVTW*

*QPPRKDPSAVQEYVVEWRELHPGGDTQVPLNWLRSRPYNVSALISENIK*

*SYICYEIRVYALSGDQGGCSSILGNSKHKAPLSGPHINAITEEKGSILI*

*SWNSIPVQEQMGCLLHYRIYWKERDSNSQPQLCIIPYRVSQNSHPINSL*

*QPRVTYVLWMTALTAAGESSHGNEREFCLQGKAN*WMAFVAPSICIAIIM

VGIFSTHYFQQKVFVLLAALRPQWCSREIPDPANSTCAKKYPIAEEKTQ

LPLDRLLIDWPTPEDPEPLVISEVLHQVTPVFRHPPCSNWPQREKGIQG

HQASEKDMMHSASSPPPPRALQAESRQLVDLYKVLESRGSDPKPENPAC

PWTVLPAGDLPTHDGYLPSNIDDLPSHEAPLADSLEELEPQHISLSVFP

SSSLHPLTFSCGDKLTLDQLKMRCDSLML

The bold indicates the pro-peptide, the italics with underline indicates the extracellular domain, the italics indicates the transmembrane domain and the bold with underline indicates the cytoplasmic domain.

In some embodiments, the masking moiety comprises the extracellular domain of human IL-12Rβ1 or a fragment, portion, or variant thereof that retains or otherwise demonstrates an affinity to IL-12.

In some embodiments, the masking moiety comprises an amino acid sequence having an amino acid sequence of human IL-12Rβ1 with one to four amino acid substitutions. In some embodiments, the masking moiety comprises an amino acid sequence having an amino acid sequence of human IL-12Rβ1 with one or two amino acid substitutions.

In some embodiments, the masking moiety comprises residues 24 to 237 of human IL-12Rβ1, namely a sequence having SEQ ID NO: 215 as shown in the IL-12 Masking Moieties table below or a fragment, portion, or variant thereof that retains or otherwise demonstrates an affinity to IL-12. In some embodiments, the masking moiety comprises IL-12Rβ1 having SEQ ID NO: 215 as shown in the IL-12 Masking Moieties table below. In some embodiments, the masking moiety comprises an amino acid sequence having about or at least about 85%, 86%, 87%, 88%, 89%, 90%, 91%, 92%, 93%, 94%, 95%, 96%, 97%, 98%, or 99% sequence identity to any one of the amino acid sequence of SEQ ID NO: 215 as shown in the IL-12 Masking Moieties table below. In some embodiments, the masking moiety comprises an amino acid sequence having the amino acid sequence of SEQ ID NO: 215 as shown in the IL-12 Masking Moieties table below, with one to four amino acid substitutions. In some embodiments, the masking moiety comprises an amino acid sequence having the amino acid sequence of SEQ ID NO: 215 as shown in the IL-12 Masking Moieties table below, with one or two amino acid substitutions.

In some embodiments, the masking moiety comprises residues 24 to 545 of human IL-12Rβ1, namely a sequence having SEQ ID NO: 216 as shown in the IL-12 Masking Moieties table below or a fragment, portion, or variant thereof that retains or otherwise demonstrates an affinity to IL-12. In some embodiments, the masking moiety comprises IL-12Rβ1 having SEQ ID NO: 216 as shown in the IL-12 Masking Moieties table below. In some embodiments, the masking moiety comprises an amino acid sequence having about or at least about 85%, 86%, 87%, 88%, 89%, 90%, 91%, 92%, 93%, 94%, 95%, 96%, 97%, 98%, or 99% sequence identity to any one of the amino acid sequence of SEQ ID NO: 216 as shown in the IL-12 Masking Moieties table below. In some embodiments, the masking moiety comprises an amino acid sequence having the amino acid sequence of SEQ ID NO: 216 as shown in the IL-12 Masking Moieties table below, with one to four amino acid substitutions. In some embodiments, the masking moiety comprises an amino acid sequence having the amino acid sequence of SEQ ID NO: 216 as shown in the IL-12 Masking Moieties table below, with one or two amino acid substitutions.

In some embodiments, the masking moiety comprises the extracellular domain of human IL-12Rβ2 or a fragment, portion, or variant thereof that retains or otherwise demonstrates an affinity to IL-12. In some embodiments, the masking moiety comprises an amino acid sequence having an amino acid sequence of human IL-12Rβ2 with one to four amino acid substitutions. In some embodiments, the masking moiety comprises an amino acid sequence having an amino acid sequence of human IL-12Rβ2 with one or two amino acid substitutions.

In some embodiments, the masking moiety comprises residues 24 to 212 of human IL-12Rβ2, namely a sequence having SEQ ID NO: 217 as shown in the IL-12 Masking Moieties table below. In some embodiments, the masking moiety comprises an amino acid sequence having about or at least about 85%, 86%, 87%, 88%, 89%, 90%, 91%, 92%, 93%, 94%, 95%, 96%, 97%, 98%, or 99% sequence identity to any one of the amino acid sequence of SEQ ID NO: 217 as shown in the IL-12 Masking Moieties table below. In some embodiments, the masking moiety comprises an amino acid sequence having the amino acid sequence of SEQ ID NO: 217 as shown in the IL-12 Masking Moieties table below, with one to four amino acid substitutions. In some embodiments, the masking moiety comprises an amino acid sequence having the amino acid sequence of SEQ ID NO: 217 as shown in the IL-12 Masking Moieties table below, with one or two amino acid substitutions.

In some embodiments, the masking moiety comprises residues 24 to 222 of human IL-12Rβ2, namely a sequence having SEQ ID NO: 218 as shown in the IL-12 Masking Moieties table below. In some embodiments, the masking moiety comprises an amino acid sequence having about or at least about 85%, 86%, 87%, 88%, 89%, 90%, 91%, 92%, 93%, 94%, 95%, 96%, 97%, 98%, or 99% sequence identity to any one of the amino acid sequence of SEQ ID NO: 218 as shown in the IL-12 Masking Moieties table below. In some embodiments, the masking moiety comprises an amino acid sequence having the amino acid sequence of SEQ ID NO: 218 as shown in the IL-12 Masking Moieties table below, with one to four amino acid substitutions. In some embodiments, the masking moiety comprises an amino acid sequence having the amino acid sequence of SEQ ID NO: 218 as shown in the IL-12 Masking Moieties table below, with one or two amino acid substitutions.

In some embodiments, the masking moiety comprises residues 24 to 319 of human IL-12Rβ2, namely a sequence having SEQ ID NO: 219 as shown in the IL-12 Masking Moieties table below. In some embodiments, the masking moiety comprises an amino acid sequence having about or at least about 85%, 86%, 87%, 88%, 89%, 90%, 91%, 92%, 93%, 94%, 95%, 96%, 97%, 98%, or 99% sequence identity to any one of the amino acid sequence of SEQ ID NO: 219 as shown in the IL-12 Masking Moieties table below. In some embodiments, the masking moiety comprises an amino acid sequence having the amino acid sequence TABLE-continued

| IL-12 Masking Moicties: | | |
|---|---|---|
| Component | SEQ ID NO | Sequence |
| IL12RB2 (24-222) | 218 | KIDACKRGDVTVKPSHVILLGSTVNITCSLKPRQGCFHYSRRNKL ILYKFDRRINFHHGHSLN SQVTGLPLGTTLFVCKLACINSDEIQICGAEIFVGVAPEQPQNLSC IQKGEQGTVACTWER GRDTHLYTEYTLQLSGPKNLTWQKQCKDIYCDYLDFGINLTPES PESNFTAKVTAVNSLGS SSSLPSTFTFLDIV |
| IL12RB2 (24-319) | 219 | KIDACKRGDVTVKPSHVILLGSTVNITCSLKPRQGCFHYSRRNKL ILYKFDRRINFHHGHSL NSQVTGLPLGTTLFVCKLACINSDEIQICGAEIFVGVAPEQPQNLS CIQKGEQGTVACTW ERGRDTHLYTEYTLQLSGPKNLTWQKQCKDIYCDYLDFGINLTP ESPESNFTAKVTAVNSL OSSSSLPSTFTFLDIVRPLPPWDIRIKFQKASVSRCTLYWRDEGLV LLNRLRYRPSNSRLWNM VNVTKAKGRHDLLDLKPFTEYEFQISSKLHLYKGSWSDWSESLR AQTPEE |
| IL12RB2 (24-319) [C242S] | 220 | KIDACKRGDVTVKPSHVILLGSTVNITCSLKPRQGCFHYSRRNKL ILYKFDRRINFHHGHSL NSQVTGLPLGTTLFVCKLACINSDEIQICGAEIFVGVAPEQPQNLS CIQKGEQGTVACTWER GRDTHLYTEYTLQLSGPKNLTWQKQCKDIYCDYLDFGINLTPES PESNFTAKVTAVNSLG SSSSLPSTFTFLDIVRPLPPWDIRIKPQKASVSRSTLYWRDEGLVL LNRLRYRPSNSRLWNM VNVTKAKGRHDLLDLKPFTEYEFQISSKLHLYKGSWSDWSESLR AQTPEE |
| IL12RB2 (24-622) | 221 | KIDACKRGDVTVKPSHVILLGSTVNITCSLKPRQGCFHYSRRNKL ILYKFDRRINFHHGHSLNS QVTGLPLGTTLFVCKLACINSDEIQICGAEIFVGVAPEQPQNLSCI QKOEQOTVACTWERGR DTHLYTEYTLQLSGPKNLTWQKQCKDIYCDYLDFGINLTPESPES NFTAKVTAVNSLGSSSSL PSTFTFLDIVRPLPPWDIRIKFQKASVSRCTLYWRDEGLVLLNRL RYRPSNSRLWNMVNVTK AKORHDLLDLKPFTEYEFQISSKLHLYKGSWSDWSESLRAQTPE EEPTGMLDVWYMKRHID YSRQQISLFWKNLSVSEARGKILHYQVTLQELTGGKAMTQNITG HTSWTTVIPRTGNWAVA VSAANSKGSSLPTRINIMNLCEAGLLAPRQVSANSEGMDNILVT WQPPRKDPSAVQEYVVE WRELHPGGDTQVPLNWLRSRPYNVSALISENIKSYICYEIRVYAL SGDQGGCSSILONSKHKAP LSGPHINAITEEKGSILISWNSIPVQEQMGCLLHYRIYWKERDSNS QPQLCEIPYRVSQNSHPIN SLQPRVTYVLWMTALTAAGESSHGNEREFCLQGKAN |
| IL12RB2 (24-227) | 222 | KIDACKRGDVTVKPSHVILLGSTVNITCSLKPRQGCFHYSRRNKL ILYKFDRRINFHHGHSLNSQVTG LPLGTTLFVCKLACINSDEIQICGAEIFVGVAPEQPQNLSCIQKGE QGTVACTWERGRDTHLYTEYTL QLSGPKNLTWQKQCKDIYCDYLDFGINLTPESPESNFTAKVTAV INSLOSSSSLPSTFTFLDIVRPLPP |

In some embodiments, the IL-12 masking moiety has an amino acid sequence as shown by one of the sequences in the table above.

1.2.3 IL-15 Cytokine Moieties and IL-15 Masking Moieties

(a) IL-15 Cytokine Moieties

In some embodiments, the therapeutic moiety comprises an IL-15 cytokine or functional fragment thereof.

IL-15 is an interleukin, which is a type of cytokine signalling molecule in the immune system that regulates activities of white blood cells.

In eukaryotic cells, IL-15 is synthesized as a precursor polypeptide of 162 amino acids, which is then processed into mature IL-15 by the removal of amino acid residues 1-48. This results in a mature form of IL-15 consisting of 114 amino acids (amino acid residues 49-162) that is secreted in a mature, active form.

IL-15 precursor polypeptide:

MRISKPHLRSISIQCYCLLLNSHFLTEAGIHVFILGCFSAGLPKTEANWVNVISKLKKIEDLIQSM

HIDATLYTESDVHPSCKVTAMKCFLLELQVISLESGDASIHDTVENLIILANNSLSSNGNVTESGC

KECEELEEKNIKEFLQSFVHIVQMFINTS

-continued

IL-15 mature polypeptide:
NWVNVISDLKKIEDLIQSMHIDATLYTESDVHPSCKVTAMKCFLLELQVISLESGDASIHDTVENL
IILANNSLSSNGNVTESGCKECEELEEKNIKEFLQSFVHIVQMFINTS The term "IL-15" or "IL-15 polypeptide" as used herein refers to any interleukin-15 (IL-15) protein, or a functional fragment or variant thereof. The term encompasses any native IL-15 from any vertebrate source, including mammals such as primates (e.g., humans) and rodents (e.g., rats and mice). The term encompasses unprocessed IL-15 (e.g., a full length, precursor form of IL-15 that consists of amino acid residues 1-162) as well as any form of IL-15 that results from processing in the cell (e.g., a mature form of IL-15 that consists of amino acid residues 49-162). As such, the term encompasses a protein encoded by the amino acid sequence of SEQ ID NO: 224 as shown in the IL-15 Cytokine Moieties table below, as well as sequence variants thereof. The term also encompasses naturally occurring variants of IL-15. The term also encompasses non-naturally occurring variants of IL-15, such as truncations, deletions, forms where IL-15 is linked to another molecule, and variants caused by at least one amino acid change to the amino acid sequence (e.g., by substitution, addition, or deletion). In some aspects, the variants or homologs have at least 90%, 95%, 96%, 97%, 98%, 99% or 100% amino acid sequence identity across the whole sequence or a portion of the sequence (e.g., a 50, 100, or 114 continuous amino acid portion) compared to a naturally occurring IL-15 polypeptide, such as an IL-15 polypeptide encoded by the amino acid sequence of SEQ ID NO: 223 or 224 as shown in the IL-15 Cytokine Moieties table below. As such, the term "IL-15" or "IL-15 polypeptide" includes an IL-15 protein comprising the amino acid sequence of SEQ ID NO: 223 or 224 as shown in the IL-15 Cytokine Moieties table below, including variants thereof, such as variants created by one or more amino acid substitutions to the amino acid sequence of SEQ ID NO: 223 or 224 as shown in the IL-15 Cytokine Moieties table below.

"Functional fragments" of an IL-15 cytokine comprise a portion of a full length cytokine protein which retains or has modified cytokine receptor binding capability (e.g., within at least 50%, 80%, 90%, 95%, 96%, 97%, 98%, 99% or 100% activity compared to the full length cytokine protein). Cytokine receptor binding capability can be shown, for example, by the capability of a cytokine to bind to the cytokine's cognate receptor or a component thereof (e.g., one or more chain(s) of a heterotrimeric receptor complex).

In some embodiments, the IL-15 cytokine or functional fragment thereof is any naturally occurring interleukin-2 (IL-15) protein or modified variant thereof capable of binding to an interleukin-2 receptor, particularly the IL-15Rα chain.

In some embodiments, the IL-15 cytokine or fragment thereof comprises SEQ ID NO: 224 as shown in the IL-15 Cytokine Moieties table below or a functional fragment thereof.

In some embodiments, the IL-15 cytokine or functional fragment thereof comprises an amino acid sequence of SEQ ID NO: 224 as shown in the IL-15 Cytokine Moieties table below.

In some embodiments, the IL-15 cytokine or functional fragment thereof comprises an amino acid sequence having at least one amino acid modification as compared to the amino acid sequence of SEQ ID NO: 224 as shown in the IL-15 Cytokine Moieties table below. Each of the at least one amino acid modifications can be any amino acid modification, such as a substitution, insertion, or deletion. In some embodiments, the IL-15 cytokine or functional fragment thereof comprises an amino acid sequence having at least 1, at least 2, at least 3, at least 4, at least 5, at least 6, at least 7, at least 8, at least 9, or at least 10 amino acid substitutions as compared to the amino acid sequence of SEQ ID NO: 224 as shown in the IL-15 Cytokine Moieties table below. In some embodiments, the IL-15 cytokine or functional fragment thereof comprises an amino acid sequence having at least 5 amino acid substitutions as compared to the amino acid sequence of SEQ ID NO: 224 as shown in the IL-15 Cytokine Moieties table below. In some embodiments, the IL-15 cytokine or functional fragment thereof comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 224 as shown in the IL-15 Cytokine Moieties table below.

In some embodiments, the IL-15 cytokine or functional fragment thereof comprises an amino acid sequence having one or more amino acid substitutions as compared to the amino acid sequence of SEQ ID NO: 224 as shown in the IL-15 Cytokine Moieties table below.

In some embodiments, the IL-15 cytokine or functional fragment thereof comprises an amino acid sequence having one or more amino acid substitutions at positions D22, E46, E53 as compared to the amino acid sequence of SEQ ID NO: 224 as shown in the IL-15 Cytokine Moieties table below. In some embodiments, the IL-15 cytokine or functional fragment thereof comprises an amino acid sequence having one or more amino acid substitutions at positions D22, E46, E53, N71, N79, N112 as compared to the amino acid sequence of SEQ ID NO: 224 as shown in the IL-15 Cytokine Moieties table below.

In some embodiments, the IL-15 cytokine or functional fragment thereof comprises an amino acid sequence having an amino acid substitution at position D22 as compared to the amino acid sequence of SEQ ID NO: 224 as shown in the IL-15 Cytokine Moieties table below.

In some embodiments, the IL-15 cytokine or functional fragment thereof comprises an amino acid sequence having an amino acid substitution at position E46 as compared to the amino acid sequence of SEQ ID NO: 224 as shown in the IL-15 Cytokine Moieties table below.

In some embodiments, the IL-15 cytokine or functional fragment thereof comprises an amino acid sequence having an amino acid substitution at position E53 as compared to the amino acid sequence of SEQ ID NO: 224 as shown in the IL-15 Cytokine Moieties table below.

In some embodiments, the IL-15 cytokine or functional fragment thereof comprises an amino acid sequence having an amino acid substitution at position N71 as compared to the amino acid sequence of SEQ ID NO: 224 as shown in the IL-15 Cytokine Moieties table below.

In some embodiments, the IL-15 cytokine or functional fragment thereof comprises an amino acid sequence having an amino acid substitution at position N79 as compared to the amino acid sequence of SEQ ID NO: 224 as shown in the IL-15 Cytokine Moieties table below.

In some embodiments, the IL-15 cytokine or functional fragment thereof comprises an amino acid sequence having an amino acid substitution at position N112 as compared to the amino acid sequence of SEQ ID NO: 224 as shown in the IL-15 Cytokine Moieties table below.

In some embodiments, the IL-15 cytokine or functional fragment thereof comprises an amino acid sequence having amino acid substitutions at positions E46 and E53 as compared to the amino acid sequence of SEQ ID NO: 224 as shown in the IL-15 Cytokine Moieties table below.

In some embodiments, the IL-15 cytokine or functional fragment thereof comprises an amino acid sequence having an amino acid substitution at position N71 and N79 as compared to the amino acid sequence of SEQ ID NO: 224 as shown in the IL-15 Cytokine Moieties table below.

In some embodiments, the IL-15 cytokine or functional fragment thereof comprises an amino acid sequence having an amino acid substitution at position N71 and N112 as compared to the amino acid sequence of SEQ ID NO: 224 as shown in the IL-15 Cytokine Moieties table below.

In some embodiments, the IL-15 cytokine or functional fragment thereof comprises an amino acid sequence having an amino acid substitution at position N79 and N112 as compared to the amino acid sequence of SEQ ID NO: 224 as shown in the IL-15 Cytokine Moieties table below.

In some embodiments, the IL-15 cytokine or functional fragment thereof comprises an amino acid sequence having an amino acid substitution at position N71, N79 and N112 as compared to the amino acid sequence of SEQ ID NO: 224 as shown in the IL-15 Cytokine Moieties table below.

In some embodiments, the amino acid substitution at position D22 is D22A.

In some embodiments, the amino acid substitution at position E46 is E46A.

In some embodiments, the amino acid substitution at position E46 is E46R.

In some embodiments, the amino acid substitution at position E46 is E46S.

In some embodiments, the amino acid substitution at position E53 is E53A.

In some embodiments, the amino acid substitution at position E53 is E53R.

In some embodiments, the amino acid substitution at position E53 is E53S.

In some embodiments, the amino acid substitution at position N71 is N71Q.

In some embodiments, the amino acid substitution at position N79 is N79Q.

In some embodiments, the amino acid substitution at position N112 is N112Q.

In some embodiments, the IL-15 cytokine or functional fragment thereof comprises an amino acid sequence having an amino acid substitution D22A as compared to the amino acid sequence of SEQ ID NO: 224 as shown in the IL-15 Cytokine Moieties table below.

In some embodiments, the IL-15 cytokine or functional fragment thereof comprises an amino acid sequence having an amino acid substitution E46A as compared to the amino acid sequence of SEQ ID NO: 224 as shown in the IL-15 Cytokine Moieties table below.

In some embodiments, the IL-15 cytokine or functional fragment thereof comprises an amino acid sequence having amino acid substitutions E46A and E53A as compared to the amino acid sequence of SEQ ID NO: 224 as shown in the IL-15 Cytokine Moieties table below.

In some embodiments, the IL-15 cytokine or functional fragment thereof comprises an amino acid sequence having amino acid substitutions E46R and E53R as compared to the amino acid sequence of SEQ ID NO: 224 as shown in the IL-15 Cytokine Moieties table below.

In some embodiments, the IL-15 cytokine or functional fragment thereof comprises an amino acid sequence having amino acid substitutions E46S and E53S as compared to the amino acid sequence of SEQ ID NO: 224 as shown in the IL-15 Cytokine Moieties table below.

In some embodiments, the IL-15 cytokine or functional fragment thereof comprises an amino acid sequence having an amino acid substitution E53A as compared to the amino acid sequence of SEQ ID NO: 224 as shown in the IL-15 Cytokine Moieties table below.

In some embodiments, the IL-15 cytokine or functional fragment thereof comprises an amino acid sequence having an amino acid substitution N71Q as compared to the amino acid sequence of SEQ ID NO: 224 as shown in the IL-15 Cytokine Moieties table below.

In some embodiments, the IL-15 cytokine or functional fragment thereof comprises an amino acid sequence having an amino acid substitution N79Q as compared to the amino acid sequence of SEQ ID NO: 224 as shown in the IL-15 Cytokine Moieties table below.

In some embodiments, the IL-15 cytokine or functional fragment thereof comprises an amino acid sequence having an amino acid substitution N112Q as compared to the amino acid sequence of SEQ ID NO: 224 as shown in the IL-15 Cytokine Moieties table below.

In some embodiments, the L-15 cytokine or functional fragment thereof comprises an amino acid sequence having an amino acid substitution N71Q and N79Q as compared to the amino acid sequence of SEQ ID NO: 224 as shown in the IL-15 Cytokine Moieties table below.

In some embodiments, the IL-15 cytokine or functional fragment thereof comprises an amino acid sequence having an amino acid substitution N71Q and N112Q as compared to the amino acid sequence of SEQ ID NO: 224 as shown in the IL-15 Cytokine Moieties table below.

In some embodiments, the IL-15 cytokine or functional fragment thereof comprises an amino acid sequence having an amino acid substitution N79Q and N112Q as compared to the amino acid sequence of SEQ ID NO: 224 as shown in the IL-15 Cytokine Moieties table below.

In some embodiments, the IL-15 cytokine or functional fragment thereof comprises an amino acid sequence having an amino acid substitution N71Q, N79Q and N112Q as compared to the amino acid sequence of SEQ ID NO: 224 as shown in the IL-15 Cytokine Moieties table below.

IL-15 Cytokine Moieties:

| Component | SEQ ID NO | Sequence | DC |
|---|---|---|---|
| hIL-15 (precursor) | 223 | MRISKPHLRSISIQCYLCLLLNSHFLTEAGIHVFILGCFSAGLPKTEA NWVN VISDLKKIEDLIQSMHIDATLYTESDVHPSCKVTAMKCFLLELQVIS LESGD | |

-continued

| IL-15 Cytokine Moieties: | | | |
|---|---|---|---|
| Component | SEQ ID NO | Sequence | DC |
| | | ASIHDTVENLIILANNSLSSNGNVTESGCKECEELEEKNIKEFLQSFV HIVQM FINTS | |
| hIL15 | 224 | NWVNVISDLKKIEDLIQSMHIDATLYTESDVHPSCKVTAMKCFLLE LQVISL ESGDASIHDTVENLIILANNSLSSNGNVTESGCKECEELEEKNIKEF LQSFVH IVQMFINTS | AK401 AK402 AK403 AK481 AK482 AK483 AK478 AK479 AK480 AK242 AK243 AK247 AK248 AK245 AK250 AK419 AK246 AK251 AK420 AK421 AK457 AK399 AK404 AK405 AK400 AK244 AK249 AK418 AK507 AK564 |
| hIL15 (D22A) | 225 | NWVNVISDLKKIEDLIQSMHIAATLYTESDVHPSCKVTAMKCFLLE LQVISLESGD ASIHDTVENLIILANNSLSSNGNVTESGCKECEELEEKNIKEFLQSFV HIVQMFINTS | AK458 |
| hIL15 (E46A) | 226 | NWVNVISDLKKIEDLIQSMHIDATLYTESDVHPSCKVTAMKCFLLA LQVISLESGDA SIHDTVENLIILANNSLSSNGNVTESGCKECEELEEKNIKEFLQSFVH IVQMFINTS | AK459 |
| hIL15 (E46A, E53A) | 227 | NWVNVISDIKKIEDLIQSMHIDATLYTESDVHPSCKVTAMKCFLLA LQVISLASGD ASIHDTVENLIILANNSLSSNGNVTESGCKECEELEEKNIKEFLQSFV HIVQMFINTS | AK461 AK527 AK506 |
| hL15 (E46R, E53R) | 228 | NWVNVISDLKKIEDLIQSMHIDATLYTESDVHPSCKVTAMKCFLLR LQVISLRSGD ASIHDTVENLIILANNSLSSNGNVTESGCKECEELEEKNIKEFLQSFV HIVQMFINTS | not named yet-2 |
| hIL15 (E46S, E53S) | 229 | NWVNVISDLKKIEDLIQSMHIDATLYTESDVHPSCKVTAMKCFLLS LQVISLSSGD ASTHDTVENLIILANNSLSSNGNVTESGCKECEELEEKNIKEFLQSFV HIVQMFINTS | not named yet-1 |
| hIL15 (E53A) | 230 | NWVNVISDLKKIEDLIQSMHIDATLYTESDVHPSCKVTAMKCFLLE LQVISLASGD ASIHDTVENLIILANNSLSSNGNVTESGCKECEELEEKNIKEFLQSFV HIVQMFINTS | AK460 |
| hIL15 (N-ter) | 231 | NWVNVISDLKKIEDLIQS | not named yet-3 not named yet-4 |

-continued

IL-15 Cytokine Moieties:

| Component | SEQ ID NO | Sequence | DC |
|---|---|---|---|
| hIL15 (C-ter) | 232 | KVTAMKCFLLELQVISLESGDASIHDTVENLILANNSLSSNGNVTE SGCKECEELEE KNIKEFLQSFVHIVQMFINTS | not named yet-3 not named yet-4 |
| IL-15 (N71Q) | 233 | NWVNVISDLKKIEDLIQSMHIDATLYTESDVHPSCKVTAMKCFLLE LQVISLESGD ASHIDTVENLIILAQNSLSSNGNVTESGCKECEELEEKNIKEFLQSFV HIVQMFNTS | AK595 AK596 |
| hIL-15 (N79Q) | 234 | NWVNVISDLKKIEDLIQSMHIDATLYTESDVHPSCKVTAMKCFLLE LQVISLESGD ASIHDTVENLIILANNSLSSNGQVTESGCKECEELEEKNIKEFLQSFV HIVQMFINTS | AK901 AK907 |
| hIL-15 (N112Q) | 235 | NWVNVISDLKKIEDLIQSMHIDATLYTESDVHPSCKVTAMKCFLLE LQVISLESGD ASIHDTVLNLITLANNSLSSNGNVTESGCKECEELEEKNIKEFLQSFV HIVQMFIQTS | AK900 AK906 |
| hIL-15 (N71Q, N79Q) | 236 | NWVNVISDLKKIEDLIQSMHIDATLYTESDVHPSCKVTAMKCFLLE LQVISLESGD ASIHDTVENLITLAQNSLSSNGQVTESGCKECEELEEKNIKEFLQSFV HIVQMFINTS | AK904 AK910 AK929 AK935 AK931 AK937 AK934 AK940 AK933 Ak939 |
| hIL-15 (N71Q, N112Q) | 237 | NWVNVISDLKKIEDLIQSMHIDATLYTESDVHPSCKVTAMKCFLLE LQVISLLSGD ASIHDTVENLIILAQNSLSSNGNVTESGCKECEELEEKNIKEFLQSFV HIVQMFIQTS | AK903 AK909 |
| hIL-15 (N79Q, N112Q) | 238 | NWVNVISDLKKIEDLIQSMHIDATLYTESDVHPSCKVTAMKCFLLE LQVISLESGD ASIHDTVENLIILANNSLSSNGQVTESGCKECEELEEKNIKEFLQSFV HIVQMFIQTS | AK902 AK908 |
| hIL-15 (N71Q, N79Q, N112Q) | 239 | NWVNVISDLKKIEDLIQSMHIDATLYTESDVHPSCKVTAMKCFLLE LQVISLESGD ASIHDTVENLIILAQNSLSSNGQVTESGCKECEELEEKNIKEFLQSFV HIVQMFIQTS | AK905 AK911 |

In some embodiments, the IL-15 cytokine moiety has an amino acid sequence as shown by one of the sequences in the table above.

In some embodiments, an additional mutation may be included in any of the sequences above at position N71. In some embodiments, the mutation is N71A, N71R, N71W, N71F, N71P, N71M, N71L, N71T, N71S, or N71Y.

In some embodiments, an additional mutation may be included in any of the sequences above at position S73. In some embodiments, the mutation is S73A, S73W, S73V, or S73M.

In some embodiments, an additional mutation may be included in any of the sequences above at one or more of amino acid positions N72, N79, V80, T81, and N112. In some embodiments, one or more additional mutations selected from N72A, N79A, V80A, T81A and N112R may be included in any of the sequences above.

In some embodiments, an additional mutation may be included in any of the sequences above at one or more of amino acid positions N72, S73, N79, V80, T81, and N112. In some embodiments, one or more additional mutations N72A, S73A, N79A, V80A, T81A, and N112 may be included in any of the sequences above.

In some embodiments, the IL-15 cytokine or functional fragment thereof has one or more amino acid residues e.g. residues 1-3 s removed as compared to the amino acid sequence of the mature IL-15 of SEQ ID 224 as shown in the IL-15 Cytokine Moieties table above, for the purpose of removing an O-glycosylation site. In some embodiments, the IL-15 cytokine or functional fragment thereof has one or more amino acid residues substituted as compared to the amino acid sequence of the mature IL-15 of SEQ ID 224 as shown in the IL-15 Cytokine Moieties table above, for the purpose of removing an O-glycosylation site. In some embodiments, the IL-15 cytokine or functional fragment thereof has one or more amino acid residues inserted, e.g. in the region of residues 1-3, as compared to the amino acid sequence of the mature IL-15 of SEQ ID 224 as shown in the IL-15 Cytokine Moieties table above, for the purpose of removing an O-glycosylation site. In some embodiments, the IL-15 cytokine or functional fragment thereof does not have an O-glycosylation site within residues 1-3.

In some embodiments, the masked IL-15 cytokine further comprises a domain comprising an IL-15Rα subunit or a functional fragment thereof ('IL-15Rα domain'). Incorporating an 'IL-15Rα domain' into a masked IL-15 cytokine construct has been demonstrated to increase the potency of said cytokine in activating CD8 T cell and NK cells.

The IL-15Rα subunit (also referred to as CD215) is structurally similar to IL-2Rα; the ectodomain of IL-15Rα consists of a single protein-binding Sushi domain, a membrane-proximal proline-threonine-rich (PT) region, and a linker/hinge region that connects the sushi domain and the PT region. The IL-15Rα subunit specifically binds IL-15 with very high affinity and is capable of binding IL-15 independently of the β and γ subunits.

Interleukin (IL)-15 is a cytokine that acts on a wide range of cell types but is most crucial for the development, homeostasis, and function of a specific group of immune cells that includes CD8 T cells, NK cells, NKT cells, and CD8αα intraepithelial lymphocytes. IL-15 signals are transmitted through the IL-2/15Rβ and common γ (γC) chains; however, it is the delivery of IL-15 to these signalling components that is quite unique. As opposed to other cytokines that are secreted, IL-15 primarily exists bound to the high affinity IL-15Rα. When IL-15/IL-15Rα complexes are shuttled to the cell surface, they can stimulate opposing cells through the β/γC receptor complex. This novel mechanism of IL-15 delivery has been called trans-presentation (S. W. Stonier and K. S. Schluns, 'Trans-presentation: a novel mechanism regulating IL-15 delivery and responses', Immunol Lett Jan. 4, 2010; 127(2): 85-92, the contents of which is incorporated herein by reference).

The IL-15Rα subunit comprises a conserved protein binding motif called a sushi domain. The sushi domain sIL-15Rα, which comprises amino acids 31 to 95 of the IL-15Rα subunit, is responsible for interacting with IL-15 and is essential for IL-15/IL-15Rα function (Wei X et al. 'The Sushi Domain of Soluble IL-15 Receptor α Is Essential for Binding IL-15 and Inhibiting Inflammatory and Allogenic Responses In Vitro and In Vivo', J Immunol Jul. 1, 2001; 167 (1) 277-282, the contents of which is incorporated herein by reference).

The sequence of the wild-type IL-15Rα subunit is shown below, along with a breakdown of the main domains (SEQ ID NO: 132):

```
         10         20         30         40
MAPRRARGCR TLGLPALLLL LLLRPPATRG ITCPPPMSVE 50         60         70         80
HADIWVKSYS LYSRERYICN SGFKRKAGTS SLTECVLNKA 90        100        110        120
TNVAHWTTPS LKCIRDPALV HQRPAPPSTV TTAGVTPQPE 130        140        150        160
SLSPSKGEPA ASSPSSNNTA ATTAAIVPGS QLMPSKSPST 170        180        190        200
GTTEISSHES SHGTPSQTTA KNWELTASAS HQPPGVYPQG
```

```
        210        220        230        240
HSDTTVAIST STVLLCGLSA VSLLACYLKS RQTPPLASVE 250        260
MEAMEALPVT WGTSSRDEDL ENCSHHL
```

<sp|Q13261|1-30 (signal peptide
MAPRRARGCRTLGLPALLLLLLLRPPATRG

<sp|Q13261|31-205 (Extracellular domain) [Note:
31-95 is canonical "Sushi domain"]
ITCPPPMSVEHADIWVKSYSLYSRERYICNSGFKRKAGTSSLTECVL
NKATNVAHWTTPSLKCIRDPALVHQRPAPPSTVTTAGVTPQPESLSP
SGKEPAASSPSSNNTAATTAAIVPGS <sp|Q13261|206-225 (Transmembrane domain)
VAISTSTVLLCGLSAVSLLACYL <sp|Q13261|229-267 (Cytoplasmic domain)
KSRQTPPLASVEMEAMEALPVTWGTSSRDEDLENCSHHL The 'IL-15Rα domain' herein can comprise the sequence of the extracellular domain of the wild-type IL-15Rα subunit or a variant thereof, such as the sequence of the extracellular domain of the wild-type IL-15Rα subunit with one or more e.g. 1, 2, 3 or 4 amino acid substitutions.

The 'IL-15Rα domain' herein can comprise the sequence of the wild-type sushi domain sIL-15Rα or a variant thereof, such as the sequence of the wild-type sushi domain sIL-15Rα with one or more e.g. 1, 2, 3 or 4 amino acid substitutions.

The 'IL-15Rα domain' herein can consist of the sequence of the wild-type sushi domain sIL-15Rα or a variant thereof, such as the sequence of the wild-type sushi domain sIL-15Rα with one or more e.g. 1, 2, 3 or 4 amino acid substitutions.

In some embodiments, the IL-15Rα domain comprises an amino acid substitution at position R26. In some embodiments, the IL-15Rα domain comprises amino acid substitution R26N. In some embodiments, the IL-15Rα domain comprises amino acid substitution R26S. In some embodiments, the IL-15Rα domain comprises an amino acid substitution at position R35. In some embodiments, the IL-15Rα domain comprises amino acid substitution R35Q. In some embodiments, the IL-15Rα domain comprises amino acid substitution R35S. In some embodiments, the IL-15Rα domain comprises an amino acid substitution at positions R26 and R35. In some embodiments, the IL-15Rα domain comprises amino acid substitutions R26S or R26N, and R35Q or R35S. In some embodiments, the IL-15Rα domain comprises amino acid substitutions R26N and R35Q.

Exemplary sequences for the IL-15Rα domain are shown below:

| Component | Sequence |
|---|---|
| hCD215 | ITCPPPMSVEHADIWVKSYSLYSRERYICNSGFKRKAGTSSLTECVLN<br>KATNVAHWTTPSLKCIRDPALVHQRPAPPSTVTTAGVTPQPESLSP<br>SGKEPAASSPSSNNTAATTAAIVPGSQLMPSKSPSTGTTEISSHESSH<br>GTPSQTTAKNWELTASASHQPPGVYPQGHSDTT |
| hCD215(1to66) | ITCPPPMSVEHADIWVKSYSLYSRERYICNSGFKRKAGTSSLTECVLNK<br>ATNVAHWTTPSLKCIRD |
| hCD215(1to66)<br>R26N | ITCPPPMSVEHADIWVKSYSLYSRENYICNSGFKRKAGTSSLTECVLNK<br>ATNVAHWTTPSLKCIRD |
| hCD215(1to66)<br>R35Q | ITCPPPMSVEHADIWVKSYSLYSRERYICNSGFKQKAGTSSLTECVLNK<br>ATNVAHWTTPSLKCIRD |
| hCD215(1to66)<br>R26S | iTCPPPMSVEHADIWVKSYSLYSRESYICNSGFKRKAGTSSLTECVLNK<br>ATNVAHWTTPSLKCIRD |
| hCD215(1to66)<br>R35S | ITCPPPMSVEHADIWVKSYSLYSRERYICNSGFKSKAGTSSLTECVLNK<br>ATNVAHWTTPSLKCIRD |
| hCD215(1to66)<br>R26N; R35Q | ITCPPPMSVEHADIWVKSYSLYSRENYICNSGFKQKAGTSSLTECVLNK<br>ATNVAHWTTPSLKCIRD |
| hCD215(Sushi) | ITCPPPMSVEHADIWVKSYSLYSRERYICNSGFKRKAGTSSLTECVLNKATN<br>VAHWTTPSLKCIRDPALVHQRPAPP |
| hCD215(Truncated) | ITCPPPMSVEHADIWVKSYSLYSRERYICNSGFKRKAGTSSLTECVLNKATNV<br>AHWTTPSLKCIRDPALVHQRPAPPSTVTTAGVTPQPESLSPSGKEPAAS |

In some embodiments, the IL-15Rα domain has an amino acid sequence as shown by one of the sequences in the table above.

(b) IL-15 Masking Moieties

Provided herein is a masking moiety for use in masking a therapeutic moiety comprising an IL-15 cytokine or functional fragment thereof.

It will be understood that the masking moiety is cleaved from the masked cytokine to form the cleavage product thereof. The masking moiety masks the IL-15 cytokine or functional fragment thereof in the masked cytokine thereby reducing or preventing binding of the IL-cytokine or functional fragment thereof to its cognate receptor. In some embodiments, the masking moiety reduces or prevents binding of the IL-15 cytokine or functional fragment thereof to IL-15Rα. In some embodiments, the masking moiety as provided herein refers to a moiety capable of binding to, or otherwise exhibiting an affinity for the IL-15 cytokine or functional fragment thereof, such as an anti-IL-15 antibody or IL-15 cognate receptor protein. Methods for determining the extent of binding of a protein (e.g., cytokine) to a cognate protein (e.g., cytokine receptor) are well known in the art.

In some embodiments, the masking moiety comprises an IL-15 cytokine receptor, or a subunit or functional fragment thereof.

In some embodiments, the masking moiety comprises IL-15Rβ (also referred to as CD122) or a fragment, portion, or variant thereof that retains or otherwise demonstrates an affinity to IL-15.

The wild type sequence of IL-15Rβ is shown in SEQ ID NO: 240 in the IL-15 Masking Moieties table below.

In some embodiments, the masking moiety comprises the amino acid sequence of SEQ ID NO: 240 in the IL-15 Masking Moieties table below. In some embodiments, the masking moiety comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 240 in the IL-15 Masking Moieties table below. In some embodiments, the masking moiety comprises an amino acid sequence having the amino acid sequence of SEQ ID NO: 240 in the IL-15 Masking Moieties table below with one to four amino acid substitutions. In some embodiments, the masking moiety comprises an amino acid sequence having the amino acid sequence of SEQ ID NO: 240 in the IL-15 Masking Moieties table below with one or two amino acid substitutions.

In some embodiments, the masking moiety comprises IL-15Rβ (or a functional fragment, portion, or variant thereof), where the IL-15Rβ has an amino acid substitution at position C122.

In some embodiments, the masking moiety comprises IL-15Rβ (or a functional fragment, portion, or variant thereof), where the IL-15Rβ has amino acid substitution C122S.

In some embodiments, the IL-15Rβ or a fragment, portion or variant thereof has an amino acid substitution at position C122 as compared to IL-15Rβ of SEQ ID NO: 240 in the IL-15 Masking Moieties table below.

In some embodiments, the IL-15Rβ or a fragment, portion or variant thereof has mutation C122S at amino acid position 122 as compared to IL-15Rβ of SEQ ID NO: 240 in the IL-15 Masking Moieties table below.

In some embodiments, the masking moiety comprises an amino acid sequence of SEQ ID NO: 240 in the IL-15 Masking Moieties table below with a C122 mutation.

In some embodiments, the masking moiety comprises an amino acid sequence of SEQ ID NO: 240 in the IL-15 Masking Moieties table below with a C122S mutation.

In some embodiments, the masking moiety comprises IL-15Rβ (or a functional fragment, portion, or variant thereof), where the IL-15Rβ has an amino acid substitution at position C168.

In some embodiments, the masking moiety comprises IL-15Rβ (or a functional fragment, portion, or variant thereof), where the IL-15Rβ has amino acid substitution C168S.

In some embodiments, the IL-15Rβ or a fragment, portion or variant thereof has mutation at amino acid position C168 as compared to IL-15Rβ of SEQ ID NO: 240 in the IL-15 Masking Moieties table below.

In some embodiments, the IL-15Rβ or a fragment, portion or variant thereof has mutation C168S at amino acid position 168 as compared to IL-15Rβ of SEQ ID NO: 240 in the IL-15 Masking Moieties table below.

In some embodiments, the masking moiety comprises an amino acid sequence of SEQ ID NO: 240 in the IL-15 Masking Moieties table below, with a C168 mutation.

In some embodiments, the masking moiety comprises an amino acid sequence of SEQ ID NO: 240 in the IL-15 Masking Moieties table below, with a C168S mutation.

In some embodiments, the IL-15Rβ or a fragment, portion or variant thereof has mutation at amino acid positions C122 and C168 as compared to IL-15Rβ of SEQ ID NO: 240 in the IL-15 Masking Moieties table below.

In some embodiments, the IL-15Rβ or a fragment, portion or variant thereof has mutation C122S and C168S as compared to IL-15Rβ of SEQ ID NO: 240 in the IL-15 Masking Moieties table below.

In some embodiments, the masking moiety comprises an amino acid sequence of SEQ ID NO: 241 in the IL-15 Masking Moieties table below.

TABLE

IL-15 Masking Moieties:

| Component | | SEQ ID NO | Sequence | DC |
|---|---|---|---|---|
| Masking moiety (MM) | hCD122 | 240 | AVNGTSQFTCFYNSRANISCVWSQ<br>DGALQDTSCQVHAWPDRRRWNQTC<br>ELLPVSQASWACNLILGAPDSQKL<br>TTVDIVTLRVLCREGVRWRVMAIQ<br>DFKPFENLRLMAPISLQVVHVETH<br>RCNISWEISQASHYFERHLEFEAR<br>TLSPGHTWEEAPLLTLKQKQEWIC<br>LETLTPDTQYEFQVRVKPLQGEFT<br>TWSPWSQPLAFRTKPAALGKD | AK247<br>AK248<br>AK421<br>AK457<br>AK249<br>AK418<br>AK250<br>AK251<br>AK399<br>AK400<br>AK404<br>AK405<br>AK419<br>AK420<br>AK401<br>AK402<br>AK403<br>AK458<br>AK459<br>AK460<br>AK461<br>AK478<br>AK479<br>AK480<br>AK481<br>AK482<br>AK483<br>AK527<br>not named yet-3<br>not named yet-4 |
| | hCD122 C122S, C168S) | 241 | AVNGTSQFTCFYNSRANISCVWSQ<br>DGALQDTSCQVHAWPDRRRWNQTC<br>ELLPVSQASWACNLILGAPDSQKL<br>TTVDIVTLRVLCREGVRWRVMAIQ<br>DFKPFENLRLMAPISLQVVHVETH<br>RSNISWEISQASHYFERHLEFEAR<br>TLSPGHTWEEAPLLTLKQKQEWIS<br>LETLTPDTQYEFQVRVKPLQGEFT<br>TWSPWSQPLAFRTKPAALGKD | AK564<br>AK596<br>AK900<br>AK901<br>AK902<br>AK903<br>AK904<br>AK905<br>AK906<br>AK907<br>AK908<br>AK909<br>AK910<br>AK911<br>AK929<br>AK935<br>AK931<br>AK937<br>AK934<br>AK940<br>AK933<br>AK939 |

In some embodiments, the IL-15 masking moiety has an amino acid sequence as shown by one of the sequences in the table above.

1.3 Non-Cleavable Peptide Linkers

Provided herein are non-cleavable peptide linkers for use in drug construct or cleavage product thereof as described herein. A non-cleavable linker as provided herein refers to a peptide of two more amino acids that is used to link two functional components together in the masked cytokines described herein.

The masked cytokine comprises a first linker and a second linker, where at least the first linker or the second linker comprises a proteolytically cleavable peptide.

In some embodiments, the second linker comprises a proteolytically cleavable peptide (linker herein referred to as a 'proteolytically cleavable linker') and the first linker does not comprise a proteolytically cleavable peptide (linker herein referred to as a 'non-cleavable linker'). This arrangement is described herein as 'Structure A'. In In some embodiments, the first polypeptide chain comprises formula:

N'HL1-non-cleavable L1-MM C' and the second polypeptide chain comprises formula:

N'HL2-cleavable L2-C C'

In some embodiments, the first linker comprises a proteolytically cleavable peptide (linker herein referred to as a 'proteolytically cleavable linker' or 'cleavable linker') and the second linker does not comprise a proteolytically cleavable peptide (linker herein referred to as a 'non-cleavable linker'). This arrangement is described herein as 'Structure B'. In some embodiments, the first polypeptide chain comprises formula:

N'HL1-cleavable L1-MM C' and the second polypeptide chain comprises formula:

N'HL2-non-cleavable L2-C C'

The non-cleavable linkers and cleavable linkers of some embodiments are described in more detail below.

In some embodiments, the non-cleavable linker is between 3 and 25 amino acids in length.

In some embodiments, the non-cleavable linker is between 3 and 18 amino acids in length.

In some embodiments, the non-cleavable linker is between 3 and 8 amino acids in length.

In some embodiments, the non-cleavable linker is between 4 and 6 amino acids in length.

In some embodiments, the non-cleavable linker is rich in amino acid residues G, S and P.

In some embodiments, the non-cleavable linker only includes amino acid residue types selected from the group consisting of G, S and P.

In some embodiments, the non-cleavable linker includes a 'GS' repeat.

In some embodiments, the non-cleavable linker includes an N' terminal 'P' residue.

In some embodiments, the non-cleavable linker comprises an amino acid sequence PGSGS (SEQ ID NO: 14).

In some embodiments, the non-cleavable linker consists of the amino acid sequence PGSGS (SEQ ID NO: 14).

In some embodiments, the non-cleavable linker comprises an amino acid sequence GGSSPPGGGSSGGGSGP (SEQ ID NO: 23).

In some embodiments, the non-cleavable linker consists of the amino acid sequence GGSSPPGGGSSGGGSGP (SEQ ID NO: 23).

In some embodiments, wherein the second linker is a proteolytically cleavable linker and the first linker is a non-cleavable linker, the non-cleavable linker comprises PGSGS (SEQ ID NO: 14). In some embodiments, wherein the second linker is a proteolytically cleavable linker and the first linker is a non-cleavable linker, the non-cleavable linker consists of the amino acid sequence PGSGS (SEQ ID NO: 14).

In some embodiments, wherein the first linker is a proteolytically cleavable linker and the second linker is a non-cleavable linker, the non-cleavable linker comprises GGSSPPGGGSSGGGSGP (SEQ ID NO: 23).

In some embodiments, wherein the first linker is a proteolytically cleavable linker and the second linker is a non-cleavable linker, the non-cleavable linker consists of the amino acid sequence GGSSPPGGGSSGGGSGP (SEQ ID NO: 23).

In some embodiments, wherein the second linker is a proteolytically cleavable linker and the first linker is a non-cleavable linker, the non-cleavable linker is between 3 and 8 amino acids in length. In some embodiments, the non-cleavable linker is between 4 and 6 amino acids in length. In some embodiments, the non-cleavable linker comprises an amino acid sequence as shown in SEQ ID NO: 14 (PGSGS).

In some embodiments, wherein the first linker is a proteolytically cleavable linker and the second linker is a non-cleavable linker, the non-cleavable linker is between 3 and 18 amino acids in length. In some embodiments, wherein the first linker is a proteolytically cleavable linker and the second linker is a non-cleavable linker, the non-cleavable linker is between 10 and 18 amino acids in length. In some embodiments, the non-cleavable linker comprises an amino acid sequence as shown in SEQ ID NO: 23 (GGSSPPGGGSSGGGSGP).

In some embodiments, it is desirable for the first and second polypeptide chains to be of the same or a similar length to facilitate the first half life extension domain associating with the second half life extension domain and the masking moiety masking the cytokine or functional fragment thereof in the assembled construct. As such where the masking moiety is a shorter amino acid sequence than the cytokine or functional fragment thereof, the difference in length may be compensated fully or in part by using a longer linker L1.

In some embodiments, the first polypeptide chain comprises formula:

N'HL1-non-cleavable L1-MM C' and the second polypeptide chain comprises formula:

N'HL2-SD1-CP-SD2-C C'

In some embodiments, the first polypeptide chain comprises formula:

N'HL1-SD1-CP-SD2-MM C' and the second polypeptide chain comprises formula:

N'HL2-non-cleavable L2-C C'

Linker combinations disclosed in exemplary AK molecules may be used with any cytokine moiety disclosed herein. Linker combinations disclosed in exemplary AK molecules may be used with any masking moiety disclosed herein. Linker combinations disclosed in exemplary AK molecules may be used with any half-life extension moieties. In other words, the linker disclosed in exemplary AK molecules may be used in combinations with any cytokine moiety disclosed herein, masking moiety disclosed herein and/or half-life extension moiety disclosed herein.

2. Cleavage Product

Provided herein is a cleavage product capable comprising an active therapeutic moiety, preparable by proteolytic cleavage of the proteolytically cleavable linker in the polypeptide drug constructs as described anywhere herein.

Provided herein is a cleavage product of a 'heterodimeric' masked cytokine described anywhere herein.

The masked cytokines described herein comprise a cleavable linker. Upon proteolytic cleavage of the cleavable linker at the cleavage site, a cleavage product comprising the cytokine moiety is formed. The cytokine moiety in the cleavage product is activated since it is no longer masked by the masking moiety. The cytokine moiety in the cleavage product is therefore capable of binding to the target protein.

The tumor cell environment is complex and can comprise multiple different proteases. As such, the precise site at which a given cleavable peptide within a masked cytokine will be cleaved in the tumor cell environment may vary between tumor types, between patients with the same tumor type and even between cleavage products formed in the same tumor. Moreover, even after cleavage, further modification of the initial cleavage product, e.g. by removal of one or two terminal amino acids, may occur by the further action of proteases in the tumor cell environment. A distribution of cleavage products can thus be expected to form in the tumor cell environment of a patient following administration of a masked cytokine as described herein.

It will be understood that a cleavage site as referred to herein refers to a site between two specific amino acid residues within the cleavable peptide that are a target for a protease known to be associated with a tumor cell environment. In this sense, there may be more than one cleavage site present in a cleavable peptide as described herein where different proteases cleave the cleavable peptide at different cleavage sites. It is also possible that more than one protease may act on the same cleavage site within a cleavable peptide. Discussion of protease cleavage sites can be found in the art.

Thus, the cleavable peptides disclosed herein may be cleaved by one or more proteases.

Provided herein is a cleavage product comprising a cytokine moiety capable of binding to it cognate receptor, preparable by proteolytic cleavage of the proteolytically cleavable linker in a masked cytokine as described anywhere herein.

Also provided herein is a distribution of cleavage products obtained or obtainable from a single structure of a masked cytokine, where each cleavage product within the distribution of cleavage products (i) is capable of binding to the target protein and (ii) comprises a cytokine (e.g. IL-2, IL-15 or IL-12 cytokine) moiety as defined anywhere herein.

Also provided herein is a cleavage product of a masked cytokine, where the cleavage product is capable of binding to the target protein, the cleavage product comprising a polypeptide comprising formula:

PCP-SD-C wherein PCP is a portion of a proteolytically cleavable peptide; SD is a spacer domain; and C is a cytokine moiety.

Further provided herein is a cleavage product of a masked cytokine, where the cleavage product is capable of binding to the target protein, the cleavage product comprising a protein heterodimer comprising:
 a) a first polypeptide chain comprising a first half-life extension moiety; and
 b) a second polypeptide chain comprising a polypeptide comprising formula:

HL2-L2-C wherein HL2 is a second half-life extension moiety; L2 is a non-cleavable linker; and C is a cytokine moiety; and wherein the first half-life extension moiety is associated with the second half-life extension moiety. Also provided herein is a distribution of cleavage products obtained or obtainable from a single structure of a masked cytokine, where each cleavage product within the distribution of cleavage products (i) is capable of binding to the target protein and (ii) comprises a protein heterodimer comprising:
 a) a first polypeptide chain comprising a first half-life extension moiety; and
 b) a second polypeptide chain comprising a polypeptide comprising formula:

HL2-L2-C wherein HL2 is a second half-life extension moiety; L2 is a non-cleavable linker; and C is a cytokine moiety; and wherein the first half-life extension moiety is associated with the second half-life extension moiety.

Further provided herein is a cleavage product of a masked cytokine, where the cleavage product is capable of binding to the target protein, the cleavage product comprising a protein heterodimer comprising:
 a) a first polypeptide chain comprising a polypeptide comprising formula:

HL1-SD-PCP wherein HL1 is a first half-life extension moiety; SD is a spacer domain; and PCP is a portion of a proteolytically cleavable peptide; and
 b) a second polypeptide chain comprising a polypeptide comprising formula:

HL2-L2-C wherein HL2 is a second half-life extension moiety; L2 is a non-cleavable linker; and C a cytokine moiety; and wherein the first half-life extension moiety is associated with the second half-life extension moiety.

Within the cleavage product, the masking moiety, half-life extension moieties, cytokine moiety, linkers, space domains may be any one of those described herein, and any combination of those described herein.

The location of the cleavable peptide determines the structure of the resulting cleavage product comprising the cytokine moiety.

A "portion of a proteolytically cleavable peptide", refers to a part of the original proteolytically cleavable peptide sequence after cleavage at the cleavage site has occurred. After cleavage, further modification of the initial cleavage product, e.g. by removal of one or two terminal amino acids, may also occur by the further action of proteases in the tumor cell environment. As such, cleavage products within the distribution of cleavage products that might be formed in the tumor cell environment of a patient following administration of a masked cytokine might not contain any portion of the proteolytically cleavable peptide.

In some embodiments, a "portion" refers to 1 amino acid, 2 amino acids, 3 amino acids, 4 amino acids, 5 amino acids or 6 amino acids of the original proteolytically cleavable peptide sequence. In some embodiments, a "portion" refers to 2 amino acids of the original proteolytically cleavable peptide sequence.

In some embodiments, a "portion" refers to 3 amino acids of the original proteolytically cleavable peptide sequence. In some embodiments, a "portion" refers to 4 amino acids of the original proteolytically cleavable peptide sequence.

In some embodiments, the 'portion' of the proteolytically cleavable peptide is from 3 to 6 amino acids in length. In some embodiments, the 'portion' of the proteolytically cleavable peptide is 3 or 4 amino acids in length.

Exemplary cleavage sites for cleavable linkers disclosed herein are disclosed below (* indicates a known or observed protease cleavage site within the cleavable peptide):

DLLA*VVAAS

ISSGLL*SG*RS

Accordingly, herein disclosed is the cleavage product of any one of the polypeptide drug constructs or masked cytokines disclosed herein.

3. Binding Assays

The strength, or affinity of immunological binding interactions, such as between a cytokine or functional fragment thereof and a binding partner (e.g., a target protein, such as a cytokine receptor) for which the cytokine or functional fragment thereof is specific, can be expressed in terms of the dissociation constant (Kd) of the interaction, wherein a smaller Kd represents a greater affinity. The binding of the cytokine to the cytokine receptor can be expressed in terms of the Kd. In some embodiments, the immunological binding interactions are between a masked cytokine (in the presence or absence of a protease) and a target protein, such as a cytokine receptor. In the context of IL-2 cytokine binding, the target protein could be IL-2R (comprising the IL-2Rα, IL-2Rβ, and IL-2Rγ chains), the IL-2Rα chain, the IL-2Rβ chain, or the IL-2Rα/β dimeric complex. Immunological binding properties of proteins can be quantified using methods well known in the art. For example, one method comprises measuring the rates of cytokine receptor (e.g., IL-2R)/cytokine (e.g., IL-2) complex formation and dissociation, wherein those rates depend on the concentrations of the complex partners, the affinity of the interaction, and geometric parameters that equally influence the rate in both directions. Both the "on rate constant" (Kon) and the "off rate constant" (Koff) can be determined by calculation of the concentrations and the actual rates of association and dissociation. The ratio of Koff/Kon enables the cancelation of all parameters not related to affinity, and is equal to the dissociation constant Kd. See Davies et al., Annual Rev Biochem. 59:439-473, (1990).

In some aspects, a masked cytokine described herein binds to a target protein with about the same or higher affinity upon cleavage with a protease as compared to the parental cytokine that comprises a masking moiety but does not comprise a cleavable peptide. The target protein can be any cytokine receptor. In some embodiments, the target protein is IL-2R (comprising the IL-2Rα, IL-2Rβ, and IL-2Rγ chains). In some embodiments, the target protein is IL-2Rα. In some embodiments, the target protein is IL-2Rβ. In some embodiments, the target protein is the IL-2Rα/β dimeric complex.

In some embodiments, a masked cytokine provided herein that does not comprise a cleavable peptide in the linker has a dissociation constant (Kd) of ≤1M, ≤150 nM, ≤100 nM, ≤50 nM, ≤10 nM, ≤1 nM, ≤0.1 nM, ≤0.01 nM, or ≤0.001 nM (e.g. 10-8 M or less, e.g. from 10-8 M to 10-13 M, e.g., from 10-9 M to 10-13 M) with the target protein. In some embodiments, a masked cytokine provided herein that comprises a cleavable peptide in the linker has a dissociation constant (Kd) of ≤1M, ≤150 nM, ≤100 nM, ≤50 nM, ≤10 nM, ≤1 nM, ≤0.1 nM, ≤0.01 nM, or 0.001 nM (e.g. 10-8 M or less, e.g. from 10-8 M to 10-13 M, e.g., from 10-9 M to 10-13 M) with the target protein prior to cleavable with a protease. In some embodiments, a masked cytokine provided herein that comprises a cleavable peptide in the linker has a dissociation constant (Kd) of ≤1M, ≤150 nM, ≤100 nM, ≤50 nM, ≤10 nM, ≤1 nM, ≤0.1 nM, ≤0.01 nM, or ≤0.001 nM (e.g. 10-8 M or less, e.g. from 10-8 M to 10-13 M, e.g., from 10-9 M to 10-13 M) with the target protein upon cleavage with a protease. In some embodiments, the cytokine or functional fragment thereof of a masked cytokine provided herein has a dissociation constant (Kd) of ≥500M, ≥250M, ≥200M, ≥150M, ≥100M, ≥50M, ≥10M, ≥1M, ≥500 nM, ≥250 nM, ≥150 nM, ≥100 nM, ≥50 nM, ≥10 nM, ≥1 nM, ≥0.1 nM, ≥0.01 nM, or ≥0.001 nM with the masking moiety of the masked cytokine. In some embodiments, the cytokine or functional fragment thereof of a masked cytokine provided herein has a dissociation constant (Kd) that is between about 200M and about 50 nM, such as about or at least about 175M, about or at least about 150M, about or at least about 125M, about or at least about 100M, about or at least about 75M, about or at least about 50M, about or at least about 25M, about or at least about 5M, about or at least about 1M, about or at least about 750 nM, about or at least about 500 nM, about or at least about 250 nM, about or at least about 150 nM, about or at least about 100 nM, about or at least about 75 nM, or about or at least about 50 nM. Assays for assessing binding affinity are well known in the art.

In some aspects, masked cytokines that exhibit a desired occlusion ratio are provided. The term "occlusion ratio" as used herein refers a ratio of (a) a maximum detected level of a parameter under a first set of conditions to (b) a minimum detected value of that parameter under a second set of conditions. In the context of a masked IL-2 polypeptide, for example, the occlusion ratio refers to the ratio of (a) a maximum detected level of target protein (e.g., IL-2R protein) binding to the masked IL-2 polypeptide in the presence of at least one protease capable of cleaving the cleavable peptide of the masked IL-2 polypeptide to (b) a minimum detected level of target protein (e.g., IL-2R protein) binding to the masked IL-2 polypeptide in the absence of the protease. Thus, the occlusion ratio for a masked cytokine can be calculated by dividing the EC50 of the masked cytokine pre-cleavage by the EC50 of the masked cytokine post-cleavage. The occlusion ratio of a masked cytokine can also be calculated as the ratio of the dissociation constant of the masked cytokine before cleavage with a protease to the dissociation constant of the masked cytokine after cleavage with a protease. In some embodiments, a greater occlusion ratio for the masked cytokine indicates that target protein bound by the masked cytokine occurs to a greater extent (e.g., predominantly occurs) in the presence of a protease capable of cleaving the cleavable peptide of the masked cytokine than in the absence of a protease.

In some embodiments, masked cytokines with an optimal occlusion ratio are provided herein. In some embodiments, an optimal occlusion ratio of a masked cytokine indicates the masked cytokine has desirable properties useful for the methods or compositions contemplated herein. In some embodiments, a masked cytokine provided herein exhibits an optimal occlusion ratio of about 2 to about 10,000, e.g., about 80 to about 100. In a further embodiment of any of the masked cytokine provided herein, the occlusion ratio is about 2 to about 7,500, about 2 to about 5,000, about 2 to about 2,500, about 2 to about 2,000, about 2 to about 1,000, about 2 to about 900, about 2 to about 800, about 2 to about 700, about 2 to about 600, about 2 to about 500, about 2 to about 400, about 2 to about 300, about 2 to about 200, about 2 to about 100, about 2 to about 50, about 2 to about 25, about 2 to about 15, about 2 to about 10, about 5 to about 10, about 5 to about 15, about 5 to about 20, about 10 to about 100, about 20 to about 100, about 30 to about 100, about 40 to about 100, about 50 to about 100, about 60 to about 100, about 70 to about 100, about 80 to about 100, or about 100 to about 1,000. In some embodiments, a masked cytokine provided herein exhibits an optimal occlusion ratio of about 2 to about 1,000. Binding of a masked cytokine to a target protein before cleavage and/or after cleavage with a protease can be determined using techniques well known in the art such as by ELISA.

In some embodiments, a masking moiety described herein binds to a cytokine or functional fragment thereof as described herein with lower affinity than the affinity between the cytokine or functional fragment thereof and a target protein (e.g., cytokine receptor). In certain embodiments, a masking moiety provided herein binds to a cytokine or functional fragment thereof as described herein with a dissociation constant (Kd) of ≥500M, ≥250M, ≥200M, ≥150M, 100M, ≥50M, ≥10M, ≥1M, ≥500 nM, ≥250 nM, ≥150 nM, ≥100 nM, ≥50 nM, ≥10 nM, ≥1 nM, ≥0.1 nM, ≥0.01 nM, or ≥0.001 nM.

4. Masked Cytokine Production

The masked cytokines described herein are prepared using techniques available in the art, exemplary methods of which are described.

4.1 Antibody Production

Some embodiments of the masked cytokine comprise an antibody or fragment thereof. The following sections provide further detail on the production of antibodies and antibody fragments, variants, and derivatives thereof, that may be used in some embodiments of the masked cytokine provided herein. In some embodiments, the masked cytokine is in the form of a dimer produced by two copies of a masked cytokine that are associated through disulfide bonds.

I. Antibody Fragments

The present invention encompasses, in some embodiments, antibody fragments. The antibody fragments can be any antibody fragments, such as an Fc domain, a portion of the heavy chain, a portion of the light chain, an Fab, an Fv, or an scFv, among other fragments. Antibody fragments may be generated by traditional means, such as enzymatic digestion, or by recombinant techniques. In certain circumstances, there are advantages of linking antibody fragments, rather than whole antibodies, to the masked cytokines described herein. For a review of certain antibody fragments, see Hudson et al. (2003) Nat. Med. 9:129-134.

Various techniques have been developed for the production of antibody fragments. Traditionally, these fragments were derived via proteolytic digestion of intact antibodies (see, e.g., Morimoto et al., Journal of Biochemical and Biophysical Methods 24:107-117 (1992); and Brennan et al., Science, 229:81 (1985)). However, these fragments can now be produced directly by recombinant host cells. Fab, Fv and ScFv antibody fragments can all be expressed in and secreted from *E. coli* and other cell types, such as HEK293 and CHO cells, thus allowing the facile production of large amounts of these fragments. Alternatively, Fab-SH fragments can be directly recovered from culture media and chemically coupled to form F(ab)2 fragments (Carter et al., Bio/Technology 10: 163-167 (1992)). According to another approach, F(ab)2 fragments can be isolated directly from recombinant host cell culture. Fab and F(ab)2 fragments with increased in vivo half-life comprising FcRN/salvage receptor binding epitope residues are described in U.S. Pat. No. 5,869,046. Other techniques for the production of antibody fragments for use in the masked cytokines will be apparent to the skilled practitioner. In certain embodiments, a masked cytokine comprises a single chain Fv fragment (scFv). See WO 93/16185; U.S. Pat. Nos. 5,571,894; and 5,587,458. scFv fusion proteins may be constructed to yield fusion of an effector protein at either the amino or the carboxy terminus of an scFv. See Antibody Engineering, ed. Borrebaeck, supra. Also, in some embodiments, bi-scFv comprising two scFvs linked via a polypeptide linker can be used with the masked cytokines.

The present invention includes, in some embodiments, a linear antibody (e.g., as described in U.S. Pat. No. 5,641,870) or a single chain immunoglobulin comprising heavy and light chain sequences of the antibody linked via an appropriate linker. Such linear antibodies or immunoglobulins may be monospecific or bispecific. Such a single chain immunoglobulin can be dimerized to thereby maintain a structure and activities similar to those of the antibody, which is originally a tetramer. Also, in some embodiments, the antibody or fragment thereof may be an antibody that has a single heavy chain variable region and has no light chain sequence. Such an antibody is called a single domain antibody (sdAb) or a nanobody. These antibodies are also encompassed in the meaning of the functional fragment of the antibody according to the present invention. Antibody fragments can be linked to the masked cytokines described herein according to the guidance provided herein.

2. Humanized Antibodies

The invention encompasses, in some embodiments, humanized antibodies or antibody fragments thereof. In some embodiments, the humanized antibodies can be any antibodies, including any antibody fragment. Various methods for humanizing non-human antibodies are known in the art. For example, a humanized antibody can have one or more amino acid residues introduced into it from a source which is non-human. These non-human amino acid residues are often referred to as "import" residues, which are typically taken from an "import" variable domain. Humanization can be essentially performed following the method of Winter (Jones et al. (1986) Nature 321:522-525; Riechmann et al. (1988) Nature 332:323-327; Verhoeyen et al. (1988) Science 239:1534-1536), by substituting hypervariable region sequences for the corresponding sequences of a human antibody. Accordingly, such "humanized" antibodies are chimeric antibodies (U.S. Pat. No. 4,816,567) wherein substantially less than an intact human variable domain has been substituted by the corresponding sequence from a non-human species. In practice, humanized antibodies are typically human antibodies in which some hypervariable region residues and possibly some FR residues are substituted by residues from analogous sites in rodent antibodies. Humanized antibodies can be linked to the masked cytokines described herein according to the guidance provided herein.

3. Human Antibodies

Human antibodies of some embodiments of the invention can be constructed by combining Fv clone variable domain sequence(s) selected from human-derived phage display libraries with known human constant domain sequences(s). Alternatively, human monoclonal antibodies of some embodiments of the invention can be made by the hybridoma method, e.g., by using mouse, rat, bovine (e.g., cow), or rabbit cells, for example, to produce the human monoclonal antibodies. In some embodiments, the human antibodies and human monoclonal antibodies can be antibodies that bind to any antigen. In some embodiments, human monoclonal antibodies of the invention can be made by immunizing a non-human animal that comprises human immunoglobulin loci with the target antigen, and isolating the antibody from the immunized animal or from cells derived from the immunized animal. Examples of suitable non-human animals include a transgenic or transchromosomic animal, such as HuMAb Mouse® (Medarex, Inc.), KM Mouse®, "TC mice," and Xenomouse™. See, e.g., Lonberg, et al. (1994) Nature 368: 856-859; Fishwild, D. et al. (1996) Nature Biotechnology 14: 845-851; WO2002/43478; U.S. Pat. Nos. 5,939,598; 6,075,181; 6,114,598; 6,150,584; 6,162,963; and Tomizuka et al. (2000) Proc. Natl. Acad. Sci. USA 97:722-727.

Human myeloma and murine-human heteromyeloma cell lines for the production of human monoclonal antibodies have been described, for example, by Kozbor J. Immunol., 133: 3001 (1984); Brodeur et al., Monoclonal Antibody Production Techniques and Applications, pp. 51-63 (Marcel Dekker, Inc., New York, 1987); and Boerner et al., J. Immunol., 147: 86 (1991). Human antibodies can be linked to the masked cytokines described herein according to the guidance provided herein.

4. Bispecific Antibodies

Bispecific antibodies are monoclonal antibodies that have binding specificities for at least two different antigens. In certain embodiments, bispecific antibodies are human or humanized antibodies. In some embodiments, one of the binding specificities is for a first antigen and the other binding specificity is for a second antigen, which may be either two different epitopes on the same target protein, or two different epitopes on two different target proteins. Bispecific antibodies may also be used to localize cytotoxic agents to cells which express the first antigen and/or the second antigen. Bispecific antibodies may also be used to recruit cells, such as T cells or natural killer cells, to kill certain cells, e.g., cancer cells. Bispecific antibodies can be prepared as full-length antibodies or antibody fragments (e.g. F(ab')2 bispecific antibodies). Bispecific antibodies can be linked to the masked cytokines described herein according to the guidance provided herein.

Methods for making bispecific antibodies are known in the art. See Milstein and Cuello, Nature, 305: 537 (1983), WO 93/08829 published May 13, 1993, Traunecker et al., EMBO J., 10: 3655 (1991); Kontermann and Brinkmann, Drug Discovery Today, 20(7):838-847. For further details of generating bispecific antibodies see, for example, Suresh et al., Methods in Enzymology, 121:210 (1986). Bispecific antibodies include cross-linked or "heteroconjugate" antibodies. For example, one of the antibodies in the heteroconjugate can be coupled to avidin, the other to biotin. Heteroconjugate antibodies may be made using any convenient cross-linking method. Suitable cross-linking agents are well known in the art, and are disclosed in U.S. Pat. No. 4,676,980, along with a number of cross-linking techniques.

5. Single-Domain Antibodies

In some embodiments, a single-domain antibody is linked to the masked cytokine in accordance with the guidance provided herein. The single-domain antibody can be any antibody. A single-domain antibody is a single polypeptide chain comprising all or a portion of the heavy chain variable domain or all or a portion of the light chain variable domain of an antibody. In certain embodiments, a single-domain antibody is a human single-domain antibody (Domantis, Inc., Waltham, Mass.; see, e.g., U.S. Pat. No. 6,248,516 B1). In some embodiments, a single-domain antibody consists of all or a portion of the heavy chain variable domain of an antibody. In some embodiment, the single domain antibody is a camelid-derived antibody obtained by immunization of a camelid with the target antigen. In some embodiments, the single domain antibody is a shark-derived antibody obtained by immunization of a shark with the target antigen. In some embodiments, the single domain antibody is a Nanobody (see, e.g., WO 2004041865A2 and US20070269422A1).

6. Antibody Variants

In some embodiments, amino acid sequence modification (s) of the antibodies or fragments thereof described herein are contemplated. For example, it may be desirable to improve the FcRn-binding affinity and/or pH-dependent FcRn-binding affinity of the antibody. It may also be desirable to promote heterodimerization of antibody heavy chains by introducing certain amino acid modifications. Methods for promoting heterodimerization of antibody chains, including certain modifications that can be made to facilitate heterodimerization, is described by Klein et al. (2012), MAbs, 4(6): 653-663.

Amino acid sequence variants of the antibody may be prepared by introducing appropriate changes into the nucleotide sequence encoding the antibody, or by peptide synthesis. Such modifications include, for example, deletions from, and/or insertions into and/or substitutions of, residues within the amino acid sequences of the antibody. Any combination of deletion, insertion, and substitution can be made to arrive at the final construct, provided that the final construct possesses the desired characteristics. The amino acid alterations may be introduced in the subject antibody amino acid sequence at the time that sequence is made.

A useful method for identification of certain residues or regions of the antibody that are preferred locations for mutagenesis is called "alanine scanning mutagenesis" as described by Cunningham and Wells (1989) Science, 244: 1081-1085. Here, a residue or group of target residues are identified (e.g., charged residues such as arg, asp, his, lys, and glu) and replaced by a neutral or negatively charged amino acid (e.g., alanine or polyalanine) to affect the interaction of the amino acids with antigen. Those amino acid locations demonstrating functional sensitivity to the substitutions then are refined by introducing further or other variants at, or for, the sites of substitution. Thus, while the site for introducing an amino acid sequence variation is predetermined, the nature of the mutation per se need not be predetermined. For example, to analyze the performance of a mutation at a given site, ala scanning or random mutagenesis is conducted at the target codon or region and the expressed immunoglobulins are screened for the desired activity.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include an antibody with an N-terminal methionyl residue. Other insertional variants of the antibody molecule include the fusion to the N- or C-terminus of the antibody to an enzyme or a polypeptide which increases the serum half-life of the antibody.

In some embodiments, the masked cytokine is modified to eliminate, reduce, or otherwise hinder protease cleavage near the hinge region. The "hinge region" of an IgG is generally defined as including E216 and terminating at P230 of human IgG1 according to the EU index as in Kabat, but, functionally, the flexible portion of the chain may be considered to include additional residues termed the upper and lower hinge regions, such as from E216 to G237 (Roux et al., 1998 J Immunol 161:4083) and the lower hinge has been referred to as residues 233 to 239 of the Fc region where FcγR binding was generally attributed. Modifications to any of the masked cytokines described herein, can be performed, for example, according to the methods described in US 20150139984A1, which is incorporated herein by reference, as well as by incorporating any of the modifications described therein.

In some embodiments, FcRn mutations that improve pharmacokinetics include, but are not limited to, M428L, T250Q/M428L, M252Y/S254T/T256E, P257I/N434H, D376V/N434H, P257I/Q3111, N434A, N434W, M428L/ N434S, V259I/V308F, M252Y/S254T/T256E, V259I/ V308F/M428L, T307Q/N434A, T307Q/N434S, T307Q/ E380A/N434A, V308P/N434A, N434H, V308P. In some embodiments, such mutations enhance antibody binding to FcRn at low pH but do not change the antibody affinity at neutral pH.

In certain embodiments, an antibody or fragment thereof is altered to increase or decrease the extent to which the antibody is glycosylated. Glycosylation of polypeptides is typically either N-linked or O-linked. N-linked refers to the attachment of a carbohydrate moiety to the side chain of an asparagine residue. The tripeptide sequences asparagine-X-serine and asparagine-X-threonine, where X is any amino acid except proline, are the recognition sequences for enzymatic attachment of the carbohydrate moiety to the asparagine side chain. Thus, the presence of either of these tripeptide sequences in a polypeptide creates a potential glycosylation site. O-linked glycosylation refers to the attachment of one of the sugars N-acetylgalactosamine, galactose, or xylose to a hydroxyamino acid, most commonly serine or threonine, although 5-hydroxyproline or 5-hydroxylysine may also be used.

Addition or deletion of glycosylation sites to the masked cytokine is conveniently accomplished by altering the amino acid sequence such that one or more of the above-described tripeptide sequences (for N-linked glycosylation sites) is created or removed. The alteration may also be made by the addition, deletion, or substitution of one or more serine or threonine residues to the sequence of the original antibody (for 0-linked glycosyl Where the antibody or fragment thereof comprises an Fc region, the carbohydrate attached thereto may be altered. For example, antibodies with a mature carbohydrate structure that lacks fucose attached to an Fc region of the antibody are described in US Pat Appl No US 2003/0157108 (Presta, L.). See also US 2004/0093621 (Kyowa Hakko Kogyo Co., Ltd). Antibodies with a bisecting N-acetylglucosamine (GlcNAc) in the carbohydrate attached to an Fc region of the antibody are referenced in WO 2003/011878, Jean-Mairet et al. and U.S. Pat. No. 6,602,684, Umana et al. Antibodies with at least one galactose residue in the oligosaccharide attached to an Fc region of the antibody are reported in WO 1997/30087, Patel et al. See, also, WO 1998/58964 (Raju, S.) and WO 1999/22764 (Raju, S.) concerning antibodies with altered carbohydrate attached to the Fc region thereof. See also US 2005/0123546 (Umana et al.) on antigen-binding molecules with modified glycosylation.

In certain embodiments, a glycosylation variant comprises an Fc region, wherein a carbohydrate structure attached to the Fc region lacks fucose or has reduced fucose. Such variants have improved ADCC function. Optionally, the Fc region further comprises one or more amino acid substitutions therein which further improve ADCC, for example, substitutions at positions 298, 333, and/or 334 of the Fc region (Eu numbering of residues). Examples of publications related to "defucosylated" or "fucose-deficient" antibodies include: US 2003/0157108; WO 2000/61739; WO 2001/29246; US 2003/0115614; US 2002/0164328; US 2004/0093621; US 2004/0132140; US 2004/0110704; US 2004/0110282; US 2004/0109865; WO 2003/085119; WO 2003/084570; WO 2005/035586; WO 2005/035778; WO2005/053742; Okazaki et al. J. Mol. Biol. 336:1239-1249 (2004); Yamane-Ohnuki et al. Biotech. Bioeng. 87: 614 (2004). Examples of cell lines producing defucosylated antibodies include Lee 13 CHO cells deficient in protein fucosylation (Ripka et al. Arch. Biochem. Biophys. 249: 533-545 (1986); US Pat Appl No US 2003/0157108 A1, Presta, L; and WO 2004/056312 A1, Adams et al., especially at Example 11), and knockout cell lines, such as alpha-1,6-fucosyltransferase gene, FUT8, knockout CHO cells (Yamane-Ohnuki et al. Biotech. Bioeng. 87: 614 (2004)), and cells overexpressing (31,4-N-acetylglycosminyltransferase III (GnT-III) and Golgi p-mannosidase II (Manll).

In any of the embodiments herein, the masked cytokine can be engineered to improve antibody-dependent cell-mediated cytotoxicity (ADCC) activity. In some embodiments, the masked cytokine may be produced in a cell line having a alpha1,6-fucosyltransferase (Fut8) knockout. In some embodiments, the host cells have been modified to have reduced intrinsic alpha1,6-fucosylation activity. Examples of methods for modifying the fucosylation pathways in mammalian host cells can be found in, e.g., Yamane-Ohnuki and Satoh, MAbs, 1(3): 230-236 (2009), the contents of which are incorporated herein by reference. Examples of methods and compositions for partially or completely inactivating the expression of the FUT8 gene can be found in, e.g., US Pub. No. 20160194665A 1; WO2006133148A2, the contents of which are incorporated herein by reference. In some embodiments, the masked cytokine is produced in the Lecl3 variant of CHO cells (see, e.g., Shields et al., J. Biol. Chem., 277(30):26733-40 (2002)) or the YB2/0 cell line having reduced FUT8 activity (see, e.g., Shinkawa et al., J. Biol. Chem., 278(5): 3466-73 (2003)). In some embodiments, small interfering RNA (siRNA) against genes relevant to alpha1,6-fucosylation can be introduced (see, e.g., Mori et al., Biotechnol. Bioeng. 88(7): 901-908 (2004); Imai-Nishiya et al., BMC Biotechnol. 7: 84 (2007); Omasa et al., J. Biosci. Bioeng., 106(2): 168-173 (2008)). In some further embodiments, the masked cytokine may be produced in a cell line overexpressing 131,4-N-acetylglycosminyltransferase III (GnT-III). In further embodiments, the cell line additionally overexpresses Golgi p-mannosidase II (Manll). In some of the embodiments herein, the masked cytokine may comprise at least one amino acid substitution in the Fc region that improves ADCC activity.

In some embodiments, the masked cytokine is altered to improve its serum half-life. To increase the serum half-life of the cytokine, one may incorporate a FcRN/salvage receptor binding epitope into a linked antibody (especially an antibody fragment) as described in U.S. Pat. No. 5,739,277, for example. As used herein, the term "salvage receptor binding epitope" refers to an epitope of the Fc region of an IgG molecule (e.g., IgG1, IgG2, IgG3, or IgG4) that is responsible for increasing the in vivo serum half-life of the IgG molecule (US 2003/0190311, U.S. Pat. Nos. 6,821,505; 6,165,745; 5,624,821; 5,648,260; 6,165,745; 5,834,597).

Another type of variant is an amino acid substitution variant. These variants have at least one amino acid residue in the antibody molecule replaced by a different residue. Sites of interest for substitutional mutagenesis include the hypervariable regions, but FR alterations are also contemplated. Conservative substitutions are shown in Table 2 under the heading of "preferred substitutions." If such substitutions result in a desirable change in biological activity, then more substantial changes, denominated "exemplary substitutions" in Table 2, or as further described below in reference to amino acid classes, may be introduced and the products screened.

TABLE 2

| Original Residue | Exemplary Substitutions | Preferred Substitutions |
| --- | --- | --- |
| Ala (A) | Val; Leu; Ile | Val |
| Arg (R) | Lys; Gln; Asn | Lys |
| Asn (N) | Gln; His; Asp; Lys; Arg | Gln |
| Asp (D) | Glu; Asn | Glu |
| Cys (C) | Ser; Ala | Ser |
| Gln (Q) | Asn; Glu | Asn |
| Glu (E) | Asp; Gln | Asp |
| Gly (G) | Ala | Ala |
| His (H) | Asn; Gln; Lys; Arg | Arg |
| Ile (I) | Leu; Val; Met; Ala; Phe; Norleucine | Leu |
| Leu (L) | Norleucine; Ile; Val; Met; Ala; Phe | Ile |
| Lys (K) | Arg; Gln; Asn | Arg |
| Met (M) | Leu; Phe; Ile | Leu |
| Phe (F) | Trp; Leu; Val; Ile; Ala; Tyr | Tyr |
| Pro (P) | Ala | Ala |
| Ser (S) | Thr | Thr |
| Thr (T) | Val; Ser | Ser |
| Trt (W) | Tyr; The | Tyr |
| Tyr (Y) | Trp; Phe; Thr; Ser | Phe |
| Val (V) | Ile; Leu; Met; Phe; Ala; Norleucine | Leu |

Substantial modifications in the biological properties of the antibody are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or c) the bulk of the side chain. Amino acids may be grouped according to similarities in the properties of their side chains (in A. L. Lehninger, in Biochemistry, second ed., pp. 73-75, Worth Publishers, New York (1975)):

(1) non-polar: Ala (A), Val (V), Leu (L), lie (I), Pro (P), Phe (F), Trp (W), Met (M)

(2) uncharged polar: Gly (G), Ser(S), Thr (T), Cys (C), Tyr (Y), Asn (N), Gin (Q)
(3) acidic: Asp (D), Glu (E)
(4) basic: Lys (K), Arg (R), His (H)

Alternatively, naturally occurring residues may be divided into groups based on common side-chain properties:
(1) hydrophobic: Norleucine, Met, Ala, Val, Leu, he;
(2) neutral hydrophilic: Cys, Ser, Thr, Asn, Gin;
(3) acidic: Asp, Glu;
(4) basic: His, Lys, Arg;
(5) residues that influence chain orientation: Gly, Pro;
(6) aromatic: Trp, Tyr, Phe.

Non-conservative substitutions will entail exchanging a member of one of these classes for another class. Such substituted residues also may be introduced into the conservative substitution sites or, into the remaining (non-conserved) sites.

Another type of substitutional variant involves the substitution of a naturally occurring amino acid residue for a non-naturally occurring amino acid residue. Non-naturally occurring amino acid residues can be incorporated, e.g., through tRNA recoding, or through any of the methods as described, e.g., in WO 2016154675A1, which is incorporated herein by reference.

One type of substitutional variant involves substituting one or more hypervariable region residues of a parent antibody (e.g., a humanized or human antibody). Generally, the resulting variant(s) selected for further development will have modified (e.g., improved) biological properties relative to the parent antibody from which they are generated. A convenient way for generating such substitutional variants involves affinity maturation using phage display, yeast display, or mammalian display. Briefly, several hypervariable region sites (e.g., 6-7 sites) are mutated to generate all possible amino acid substitutions at each site. The antibodies thus generated are displayed from filamentous phage particles as fusions to at least part of a phage coat protein (e.g., the gene III product of M13) packaged within each particle. The phage-displayed variants are then screened for their biological activity (e.g., binding affinity). In order to identify candidate hypervariable region sites for modification, scanning mutagenesis (e.g., alanine scanning) can be performed to identify hypervariable region residues contributing significantly to antigen binding. Alternatively, or additionally, it may be beneficial to analyze a crystal structure of the antigen-antibody complex to identify contact points between the antibody and antigen. Such contact residues and neighbouring residues are candidates for substitution according to techniques known in the art, including those elaborated herein. Once such variants are generated, the panel of variants is subjected to screening using techniques known in the art, including those described herein, and antibodies with superior properties in one or more relevant assays may be selected for further development.

Nucleic acid molecules encoding amino acid sequence variants of the masked cytokines are prepared by a variety of methods known in the art. These methods include, but are not limited to, isolation from a natural source (in the case of naturally occurring amino acid sequence variants) or preparation by oligonucleotide-mediated (or site-directed) mutagenesis, PCR mutagenesis, and cassette mutagenesis of an earlier prepared variant or a non-variant version of the antibody, for example.

It may be desirable to introduce one or more amino acid modifications in an Fc region of antibodies of the invention, thereby generating an Fc region variant. The Fc region variant may comprise a human Fc region sequence (e.g., a human IgG1, IgG2, IgG3 or IgG4 Fc region) comprising an amino acid modification (e.g. a substitution) at one or more amino acid positions including that of a hinge cysteine.

In some embodiments, a masked cytokine provided herein includes an antibody or fragment thereof having an IgG1, IgG2, IgG3, or IgG4 isotype with enhanced effector function. In some embodiments, a masked cytokine provided herein includes an antibody or fragment thereof having an IgG1 isotype with enhanced effector function. In some embodiments, a masked cytokine provided herein has an IgG1 isotype with enhanced effector function. In some embodiments, the masked cytokine is afucosylated. In some embodiments, the masked cytokine has increased levels of mannose moieties. In some embodiments, the masked cytokine has increased levels of bisecting glycan moieties. In some embodiments, the IgG1 comprises amino acid mutations.

In some embodiments, a masked cytokine provided herein includes an antibody having an IgG1 isotype (e.g., a human IgG1 isotype). In some embodiments, the IgG1 comprises one or more amino acid substitutions that enhance effector function. In one embodiment, the IgG1 comprises the amino acid substitutions S298A, E333A, and K334A wherein the amino acid residues are numbered according to the EU index as in Kabat. In one embodiment, the IgG1 comprises the amino acid substitutions S239D and 1332E wherein the amino acid residues are numbered according to the EU index as in Kabat. In one embodiment, the IgG1 comprises the amino acid substitutions S239D, A330L, and 1332E wherein the amino acid residues are numbered according to the EU index as in Kabat. In one embodiment, the IgG1 comprises the amino acid substitutions P247I and A339D or A339Q wherein the amino acid residues are numbered according to the EU index as in Kabat. In one embodiment, the IgG1 comprises the amino acid substitutions D280H, K290S with or without S298D or S298V wherein the amino acid residues are numbered according to the EU index as in Kabat. In one embodiment, the IgG1 comprises the amino acid substitutions F243L, R292P, and Y300L wherein the amino acid residues are numbered according to the EU index as in Kabat. In one embodiment, the IgG1 comprises the amino acid substitutions F243L, R292P, Y300L, and P396L wherein the amino acid residues are numbered according to the EU index as in Kabat. In one embodiment, the IgG1 comprises the amino acid substitutions F243L, R292P, Y300L, V3051, and P396L wherein the amino acid residues are numbered according to the EU index as in Kabat. In one embodiment, the IgG1 comprises the amino acid substitutions G236A, S239D, and 1332E wherein the amino acid residues are numbered according to the EU index as in Kabat. In one embodiment, the IgG1 comprises the amino acid substitutions K326A and E333A wherein the amino acid residues are numbered according to the EU index as in Kabat. In one embodiment, the IgG1 comprises the amino acid substitutions K326W and E333S wherein the amino acid residues are numbered according to the EU index as in Kabat. In one embodiment, the IgG1 comprises the amino acid substitutions K290E, S298G, T299A, with or without K326E wherein the amino acid residues are numbered according to the EU index as in Kabat. In one embodiment, the IgG1 comprises the amino acid substitutions K290N, S298G, T299A, with or without K326E wherein the amino acid residues are numbered according to the EU index as in Kabat. In one embodiment, the IgG1 comprises the amino acid substitution K334V wherein the amino acid residues are numbered according to the EU index as in Kabat. In one embodiment, the IgG1 comprises the amino acid substitutions L235S, S239D, and K334V wherein the amino acid residues are numbered according to the EU index as in Kabat. In one embodiment, the IgG1 comprises the amino acid substitutions K334V and Q331M, S239D, F243V, E294L, or S298T wherein the amino acid residues are numbered according to the EU index as in Kabat. In one embodiment, the IgG1 comprises the amino acid substitutions E233L, Q311M, and K334V wherein the amino acid residues are numbered according to the EU index as in Kabat. In one embodiment, the IgG1 comprises the amino acid substitutions L234I, Q311M, and K334V wherein the amino acid residues are numbered according to the EU index as in Kabat. In one embodiment, the IgG1 comprises the amino acid substitutions K334V and S298T, A330M, or A330F wherein the amino acid residues are numbered according to the EU index as in Kabat. In one embodiment, the IgG1 comprises the amino acid substitutions K334V, Q311M, and either A330M or A330F wherein the amino acid residues are numbered according to the EU index as in Kabat. In one embodiment, the IgG1 comprises the amino acid substitutions K334V, S298T, and either A330M or A330F wherein the amino acid residues are numbered according to the EU index as in Kabat. In one embodiment, the IgG1 comprises the amino acid substitutions K334V, S239D, and either A330M or S298T wherein the amino acid residues are numbered according to the EU index as in Kabat. In one embodiment, the IgG1 comprises the amino acid substitutions L234Y, Y296W, and K290Y, F243V, or E294L wherein the amino acid residues are numbered according to the EU index as in Kabat. In one embodiment, the IgG1 comprises the amino acid substitutions Y296W and either L234Y or K290Y wherein the amino acid residues are numbered according to the EU index as in Kabat. In one embodiment, the IgG1 comprises the amino acid substitutions S239D, A330S, and I332E wherein the amino acid residues are numbered according to the EU index as in Kabat.

In some embodiments, the IgG1 comprises one or more amino acid substitutions that decrease or inhibit effector function. In one embodiment, the IgG1 comprises the amino acid substitution N297A, N297G, or N297Q wherein the amino acid residues are numbered according to the EU index as in Kabat. In one embodiment, the IgG1 comprises the amino acid substitution L234A or L235A wherein the amino acid residues are numbered according to the EU index as in Kabat. In one embodiment, the IgG1 comprises the amino acid substitutions C220S, C226S, C229S, and P238S wherein the amino acid residues are numbered according to the EU index as in Kabat. In one embodiment, the IgG1 comprises the amino acid substitutions C226S, C229S, E233P, L234V, and L235A wherein the amino acid residues are numbered according to the EU index as in Kabat. In one embodiment, the IgG1 comprises the amino acid substitutions L234F, L235E, and P331S wherein the amino acid residues are numbered according to the EU index as in Kabat. In one embodiment, the IgG1 comprises the amino acid substitutions S267E and L328F wherein the amino acid residues are numbered according to the EU index as in Kabat.

In accordance with this description and the teachings of the art, it is contemplated that in some embodiments, an antibody or fragment thereof of the masked cytokine may comprise one or more alterations as compared to the wild type counterpart antibody, e.g. in the Fc region. For example, it is thought that certain alterations can be made in the Fc region that would result in altered (i.e., either improved or diminished) C1q binding and/or Complement Dependent Cytotoxicity (CDC), e.g., as described in WO99/51642. See also Duncan & Winter Nature 322:738-40 (1988); U.S. Pat. Nos. 5,648,260; 5,624,821; and WO94/29351 concerning other examples of Fc region variants. WO00/42072 (Presta) and WO 2004/056312 (Lowman) describe antibody variants with improved or diminished binding to FcRs. The content of these patent publications are specifically incorporated herein by reference. See also Shields et al. J. Biol. Chem. 9(2): 6591-6604 (2001). Antibodies with increased half-lives and improved binding to the neonatal Fc receptor (FcRn), which is responsible for the transfer of maternal IgGs to the fetus (Guyer et al., J. Immunol. 117:587 (1976) and Kim et al., J. Immunol. 24:249 (1994)), are described in US2005/0014934A1 (Hinton et al.). These antibodies comprise an Fc region with one or more substitutions therein which improve binding of the Fc region to FcRn. Polypeptide variants with altered Fc region amino acid sequences and increased or decreased C1q binding capability are described in U.S. Pat. No. 6,194,551B1, WO99/51642. The contents of those patent publications are specifically incorporated herein by reference. See, also, Idusogie et al. J. Immunol. 164: 4178-4184 (2000).

4.2 Masked Cytokine-Drug Conjugates

The invention also provides masked cytokine-drug conjugates (MCDCs) comprising a masked cytokine provided herein, which can be any masked cytokine disclosed herein, conjugated to one or more agents. In some embodiments, the one or more agents is a cytotoxic agent, such as a chemotherapeutic agent or drug, growth inhibitory agent, toxin (e.g., protein toxin, enzymatically active toxin of bacterial, fungal, plant, or animal origin, or fragments thereof), or radioactive isotopes. In some embodiments, the one or more agents is an immune stimulant.

In some embodiments, the one or more drugs conjugated to the masked cytokine includes, but is not limited to, a maytansinoid (see U.S. Pat. Nos. 5,208,020, 5,416,064 and European Patent EP 0 425 235 B1); an auristatin such as monomethylauristatin drug moieties DE and DF (MMAE and MMAF) (see U.S. Pat. Nos. 5,635,483 and 5,780,588, and 7,498,298); a dolastatin; a calicheamicin or derivative thereof (see U.S. Pat. Nos. 5,712,374, 5,714,586, 5,739,116, 5,767,285, 5,770,701, 5,770,710, 5,773,001, and 5,877,296; Hinman et ak, Cancer Res. 53:3336-3342 (1993); and Lode et ak, Cancer Res. 58:2925-2928 (1998)); an anthracycline such as daunomycin or doxorubicin (see Kratz et ak, Current Med. Chem. 13:477-523 (2006); Jeffrey et ak, Bioorganic & Med. Chem. Letters 16:358-362 (2006); Torgov et ak, Bioconj. Chem. 16:717-721 (2005); Nagy et ak, Proc. Natl. Acad. Sci. USA 97:829-834 (2000); Dubowchik et ak, Bioorg. & Med. Chem. Letters 12:1529-1532 (2002); King et ak, J. Med. Chem. 45:4336-4343 (2002); and U.S. Pat. No. 6,630,579); methotrexate; vindesine; a taxane such as docetaxel, paclitaxel, larotaxel, tesetaxel, and ortataxel; a trichothecene; and CC1065.

In another embodiment, the one or more drugs conjugated to the masked cytokine includes, but is not limited to, an inhibitor of tubulin polymerization (e.g., maytansinoids and auristatins), DNA damaging agents (e.g., pyrrolobenzodiazepine (PBD) dimers, calicheamicins, duocarmycins and indo-linobenzodiazepine dimers), and DNA synthesis inhibitors (e.g., exatecan derivative Dxd).

In another embodiment, a masked cytokine-drug conjugate comprises a masked cytokine as described herein conjugated to an enzymatically active toxin or fragment thereof, including, but not limited to, diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), *Momordica charantia* inhibitor, curcin, crotin, *Sapaonaria officinalis* inhibitor, gelonin, mitogellin, restrictocin, phenomycin, enomycin, and the tricothecenes.

In another embodiment, a masked cytokine-drug conjugate comprises a masked cytokine as described herein conjugated to a radioactive atom to form a radioconjugate. A variety of radioactive isotopes are available for the production of radioconjugates. Examples include At211, 1131,1125, Y90, Re186, Re188, Sm153, B1212, P32, Pb212 and radioactive isotopes of Lu. When the radioconjugate is used for detection, it may comprise a radioactive atom for scintigraphic studies, for example tc99m or 1123, or a spin label for nuclear magnetic resonance (NMR) imaging (also known as magnetic resonance imaging, mri), such as iodine-123 again, iodine-131, indium-111, fluorine-19, carbon-13, nitrogen-15, oxygen-17, gadolinium, manganese or iron.

In some embodiments, a masked cytokine-drug conjugate comprises a masked cytokine as described herein conjugated to one or more immune stimulants. In some embodiments, the immune stimulant is a stimulator of interferon genes (STING) agonist or a toll-like receptor (TER) agonist.

The STING agonist can be any agonist of STING. In some embodiments, the STING agonist is a cyclic dinucleotide (CDN). The CDN can be any CDN or derivative or variant thereof. In some embodiments, the STING agonist is a CDN selected from the group consisting of cGAMP, c-di-AMP, c-di-GMP, cAIMP, and c-di-IMP. In some embodiments, the STING agonist is a derivative or variant of a CDN selected from the group consisting of cGAMP, c-di-AMP, c-di-GMP, cAIMP, and c-di-IMP. In some embodiments, the STING agonist is 4-(2-chloro-6-fluorobenzyl)-N-(furan-2-ylmethyl)-3-oxo-3,4-dihydro-2H-benzo[b][1,4]thiazine-6-carboxamide, or a derivative or variant thereof. See, e.g., Sali et al. (2015) PloS Pathog., 11(12): e!005324.

The TLR agonist can be an agonist of any TLR, such as TLR1, TLR2, TLR3, TLR4, TLR5, TLR6, TLR7, TLR8, TLR9, or TLR10. In some embodiments, the TLR agonist is an agonist of a TLR expressed on the cell surface, such as TLR1, TLR2, TLR4, or TLR5. In some embodiments, the TLR agonist is an agonist of a TLR expressed intracellularly, such as TLR3, TLR7, TLR8, TLR9, or TLR10.

Conjugates of a masked cytokine and a cytotoxic agent may be made using a variety of bifunctional protein coupling agents such as N-succinimidyl-3-(2-pyridyldithio) propionate (SPDP), succinimidyl-4-(N-maleimidomethyl) cyclohexane-1-carboxylate (SMCC), iminothiolane (IT), bifunctional derivatives of imidoesters (such as dimethyl adipimidate HCl), active esters (such as disuccinimidyl suberate), aldehydes (such as glutaraldehyde), bis-azido compounds (such as bis (p-azidobenzoyl) hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2,4-dinitrobenzene). For example, a ricin immunotoxin can be prepared as described in Vitetta et ah, Science 238:1098 (1987). Carbon-14-labeled 1-isothiocyanatobenzyl-3-methyldiethylene triaminepentaacetic acid (MX-DTPA) is an exemplary chelating agent for conjugation of radionucleotide to an antibody. See WO94/11026. The linker may be a "cleavable linker" facilitating release of a cytotoxic drug in the cell. For example, an acid-labile linker, peptidase-sensitive linker, photolabile linker, dimethyl linker or disulfide-containing linker (Chari et ah, Cancer Res. 52:127-131 (1992); U.S. Pat. No. 5,208,020) may be used.

The MCDCs herein expressly contemplate, but are not limited to such conjugates prepared with cross-linker reagents including, but not limited to, BMPS, EMCS, GMBS, HBVS, LC-SMCC, MBS, MPBH, SBAP, SIA, SIAB, SMCC, SMPB, SMPH, sulfo-EMCS, sulfo-GMBS, sulfo-KMUS, sulfo-MBS, sulfo-SIAB, sulfo-SMCC, and sulfo-SMPB, and SVSB (succinimidyl-(4-vinylsulfonejbenzoate) which are commercially available (e.g., from Pierce Biotechnology, Inc., Rockford, IL., U.S.A).

4.3 Vectors, Host Cells, and Recombinant Methods

For recombinant production of a masked cytokine of the invention, the one or more nucleic acids encoding it is isolated and inserted into a replicable vector for further cloning (amplification of the DNA) or for expression. DNA encoding the masked cytokine, including components thereof, is readily isolated and sequenced using conventional procedures. Many vectors are available. The choice of vector depends in part on the host cell to be used. Generally, host cells are of either prokaryotic or eukaryotic (generally mammalian) origin. It will be appreciated that constant regions of any isotype of antibody or fragment thereof, when applicable, can be used for this purpose, including IgG, IgM, IgA, IgD, and IgE constant regions, and that such constant regions can be obtained from any human or animal species. In some embodiments, one vector is used to encode the masked cytokine. In some embodiments, more than one vector is used to encode the masked cytokine.

1. Generating Masked Cytokines Using Prokaryotic Host Cells a. Vector Construction Polynucleotide sequences encoding polypeptide components of the masked cytokines of the invention can be obtained using standard recombinant techniques. Desired polynucleotide sequences of an antibody or antibody fragment thereof may be isolated and sequenced from antibody producing cells such as hybridoma cells. Alternatively, polynucleotides can be synthesized using nucleotide synthesizer or PGR techniques, or obtained from other sources. Once obtained, sequences encoding the components of the masked cytokine are inserted into a recombinant vector capable of replicating and expressing heterologous polynucleotides in prokaryotic hosts. Many vectors that are available and known in the art can be used for the purpose of the present invention. Selection of an appropriate vector will depend mainly on the size of the nucleic acids to be inserted into the vector and the particular host cell to be transformed with the vector. Each vector contains various components, depending on its function (amplification or expression of heterologous polynucleotide, or both) and its compatibility with the particular host cell in which it resides. The vector components generally include, but are not limited to: an origin of replication, a selection marker gene, a promoter, a ribosome binding site (RBS), a signal sequence, the heterologous nucleic acid insert and a transcription terminator sequence.

In general, plasmid vectors containing replicon and control sequences which are derived from species compatible with the host cell are used in connection with these hosts. The vector ordinarily carries a replication site, as well as marking sequences which are capable of providing phenotypic selection in transformed cells. For example, *E. coli* is typically transformed using pBR322, a plasmid derived from an *E. coli* species. pBR322 contains genes-encoding ampicillin (Amp) and tetracycline (Tet) resistance and thus provides easy means for identifying transformed cells.

pBR322, its derivatives, or other microbial plasmids or bacteriophage may also contain, or be modified to contain, promoters which can be used by the microbial organism for expression of endogenous proteins. Examples of pBR322 derivatives used for expression of particular antibodies are described in detail in Carter et ah, U.S. Pat. No. 5,648,237.

In addition, phage vectors containing replicon and control sequences that are compatible with the host microorganism can be used as transforming vectors in connection with these hosts. For example, bacteriophage such as 7GEM.TM.-11 may be utilized in making a recombinant vector which can be used to transform susceptible host cells such as E. coli LE392.

The expression vector of the invention may comprise two or more promoter-cistron pairs, encoding each of the polypeptide components. A promoter is an untranslated regulatory sequence located upstream (5') to a cistron that modulates its expression. Prokaryotic promoters typically fall into two classes, inducible and constitutive. Inducible promoter is a promoter that initiates increased levels of transcription of the cistron under its control in response to changes in the culture condition, e.g. the presence or absence of a nutrient or a change in temperature.

A large number of promoters recognized by a variety of potential host cells are well known. The selected promoter can be operably linked to cistron DNA encoding either chain of the masked cytokine by removing the promoter from the source DNA via restriction enzyme digestion and inserting the isolated promoter sequence into the vector of the invention. Both the native promoter sequence and many heterologous promoters may be used to direct amplification and/or expression of the target genes.

In some embodiments, heterologous promoters are utilized, as they generally permit greater transcription and higher yields of expressed target gene as compared to the native target polypeptide promoter.

Promoters suitable for use with prokaryotic hosts include the PhoA promoter, the β-galactamase and lactose promoter systems, a tryptophan (trp) promoter system and hybrid promoters such as the tac or the trc promoter. However, other promoters that are functional in bacteria (such as other known bacterial or phage promoters) are suitable as well. Their nucleotide sequences have been published, thereby enabling a skilled worker operably to ligate them to cistrons encoding, for example, the target light and heavy chains for masked cytokines comprising a light and heavy chain (Siebenlist et al. (1980) Cell 20: 269) using linkers or adaptors to supply any required restriction sites.

In one aspect of the invention, each cistron within the recombinant vector comprises a secretion signal sequence component that directs translocation of the expressed polypeptides across a membrane. In general, the signal sequence may be a component of the vector, or it may be a part of the target polypeptide DNA that is inserted into the vector. The signal sequence selected for the purpose of this invention should be one that is recognized and processed (i.e. cleaved by a signal peptidase) by the host cell. For prokaryotic host cells that do not recognize and process the signal sequences native to the heterologous polypeptides, the signal sequence is substituted by a prokaryotic signal sequence selected, for example, from the group consisting of the alkaline phosphatase, penicillinase, Ipp, or heat-stable enterotoxin II (STII) leaders, LamB, PhoE, PelB, OmpA and MBP. In one embodiment of the invention, the signal sequences used in both cistrons of the expression system are STII signal sequences or variants thereof.

In another aspect, the production of the polypeptide components according to the invention can occur in the cytoplasm of the host cell, and therefore does not require the presence of secretion signal sequences within each cistron. In that regard, for embodiments comprising immunoglobulin light and heavy chains, for example, the light and heavy chains are expressed with or without the sequences for the masking moiety, linker sequence, etc., folded and assembled to form functional immunoglobulins within the cytoplasm. Certain host strains (e.g., the *E. coli* trxB-strains) provide cytoplasm conditions that are favorable for disulfide bond formation, thereby permitting proper folding and assembly of expressed protein subunits. Proba and Pluckthun Gene, 159:203 (1995).

Masked cytokines of the invention can also be produced by using an expression system in which the quantitative ratio of expressed polypeptide components can be modulated in order to maximize the yield of secreted and properly assembled antibodies of the invention. Such modulation is accomplished at least in part by simultaneously modulating translational strengths for the polypeptide components.

Prokaryotic host cells suitable for expressing masked cytokines of the invention include Archaebacteria and Eubacteria, such as Gram-negative or Gram-positive organisms. Examples of useful bacteria include *Escherichia* (e.g., *E. coli*), Bacilli (e.g., *B. subtilis*), Enterobacteria, *Pseudomonas* species (e.g., *P. aeruginosa*), *Salmonella typhimurium, Serratia marcescans, Klebsiella, Proteus, Shigella, Rhizobia, Vitreoscilla*, or *Paracoccus*. In one embodiment, gram-negative cells are used. In one embodiment, *E. coli* cells are used as hosts for the invention. Examples of *E. coli* strains include strain W3110 (Bachmann, Cellular and Molecular Biology, vol. 2 (Washington, D.C.: American Society for Microbiology, 1987), pp. 1190-1219; ATCC Deposit No. 27,325) and derivatives thereof, including strain 33D3 having genotype W3110 AfhuA (AtonA) ptr3 lac Iq lacL8 AompTA(nmpc-fepE) degP41 kanR (U.S. Pat. No. 5,639,635). Other strains and derivatives thereof, such as *E. coli* 294 (ATCC 31,446), *E. coli* B, E. colik 1776 (ATCC 31,537) and *E. coli* RV308 (ATCC 31,608) are also suitable. These examples are illustrative rather than limiting. Methods for constructing derivatives of any of the above-mentioned bacteria having defined genotypes are known in the art and described in, for example, Bass et ah, Proteins, 8:309-314 (1990). It is generally necessary to select the appropriate bacteria taking into consideration replicability of the replicon in the cells of a bacterium. For example, *E. coli, Serratia*, or *Salmonella* species can be suitably used as the host when well-known plasmids such as pBR322, pBR325, pACYC177, or pKN410 are used to supply the replicon. Typically, the host cell should secrete minimal amounts of proteolytic enzymes, and additional protease inhibitors may desirably be incorporated in the cell culture.

b. Masked Cytokine Production

Host cells are transformed with the above-described expression vectors and cultured in conventional nutrient media modified as appropriate for inducing promoters, selecting transformants, or amplifying the genes encoding the desired sequences.

Transformation means introducing DNA into the prokaryotic host so that the DNA is replicable, either as an extrachromosomal element or by chromosomal integrant. Depending on the host cell used, transformation is done using standard techniques appropriate to such cells. The calcium treatment employing calcium chloride is generally used for bacterial cells that contain substantial cell-wall barriers. Another method for transformation employs polyethylene glycol/DMSO. Yet another technique used is electroporation.

Prokaryotic cells used to produce the masked cytokines of the invention are grown in media known in the art and suitable for culture of the selected host cells. Examples of suitable media include luria broth (LB) plus necessary nutrient supplements. In some embodiments, the media also contains a selection agent, chosen based on the construction of the expression vector, to selectively permit growth of prokaryotic cells containing the expression vector. For example, ampicillin is added to media for growth of cells expressing ampicillin resistant gene.

Any necessary supplements besides carbon, nitrogen, and inorganic phosphate sources may also be included at appropriate concentrations introduced alone or as a mixture with another supplement or medium such as a complex nitrogen source. Optionally, the culture medium may contain one or more reducing agents selected from the group consisting of glutathione, cysteine, cystamine, thioglycollate, dithioerythritol and dithiothreitol.

The prokaryotic host cells are cultured at suitable temperatures. In certain embodiments, for E. coli growth, growth temperatures range from about 20° C. to about 39° C.; from about 25° C. to about 37° C.; or about 30° C. The pH of the medium may be any pH ranging from about 5 to about 9, depending mainly on the host organism. In certain embodiments, for E. coli, the pH is from about 6.8 to about 7.4, or about 7.0.

If an inducible promoter is used in the expression vector of the invention, protein expression is induced under conditions suitable for the activation of the promoter. In one aspect of the invention, PhoA promoters are used for controlling transcription of the polypeptides. Accordingly, the transformed host cells are cultured in a phosphate-limiting medium for induction. In certain embodiments, the phosphate-limiting medium is the C.R.A.P. medium (see, e.g., Simmons et ah, J. Immunol. Methods (2002), 263:133-147). A variety of other inducers may be used, according to the vector construct employed, as is known in the art.

In one embodiment, the expressed masked cytokines of the present invention are secreted into and recovered from the periplasm of the host cells. Protein recovery typically involves disrupting the microorganism, generally by such means as osmotic shock, sonication or lysis. Once cells are disrupted, cell debris or whole cells may be removed by centrifugation or filtration. The proteins may be further purified, for example, by affinity resin chromatography. Alternatively, proteins can be transported into the culture media and isolated therein. Cells may be removed horn the culture and the culture supernatant being filtered and concentrated for further purification of the proteins produced. The expressed polypeptides can be further isolated and identified using commonly known methods such as polyacrylamide gel electrophoresis (PAGE) and Western blot assay.

In one aspect of the invention, masked cytokine production is conducted in large quantity by a fermentation process. Various large-scale fed-batch fermentation procedures are available for production of recombinant proteins. Large-scale fermentations have at least 1000 liters of capacity, and in certain embodiments, about 1,000 to 100,000 liters of capacity. These fermenters use agitator impellers to distribute oxygen and nutrients, especially glucose. Small scale fermentation refers generally to fermentation in a fermentor that is no more than approximately 100 liters in volumetric capacity, and can range horn about 1 liter to about 100 liters.

In a fermentation process, induction of protein expression is typically initiated after the cells have been grown under suitable conditions to a desired density, e.g., an OD550 of about 180-220, at which stage the cells are in the early stationary phase. A variety of inducers may be used, according to the vector construct employed, as is known in the art and described above. Cells may be grown for shorter periods prior to induction. Cells are usually induced for about 12-50 hours, although longer or shorter induction time may be used.

To improve the production yield and quality of the polypeptides of the invention, various fermentation conditions can be modified. For example, to improve the proper assembly and folding of, for example, secreted antibody polypeptides, additional vectors overexpressing chaperone proteins, such as Dsb proteins (DsbA, DsbB, DsbC, DsbD and or DsbG) or FkpA (a peptidylprolyl cis,trans-isomerase with chaperone activity) can be used to co-transform the host prokaryotic cells. The chaperone proteins have been demonstrated to facilitate the proper folding and solubility of heterologous proteins produced in bacterial host cells. Chen et al. (1999) J. Biol. Chem. 274:19601-19605; Georgiou et ak, U.S. Pat. No. 6,083,715; Georgiou et ak, U.S. Pat. No. 6,027,888; Bothmann and Pluckthun (2000) J. Biol. Chem. 275:17100-17105; Ramm and Pluckthun (2000) J. Biol. Chem. 275:17106-17113; Arie et ak (2001) Mol. Microbiol. 39:199-210.

To minimize proteolysis of expressed heterologous proteins (especially those that are proteolytically sensitive), certain host strains deficient for proteolytic enzymes can be used for the present invention. For example, host cell strains may be modified to effect genetic mutation(s) in the genes encoding known bacterial proteases such as Protease III, OmpT, DegP, Tsp, Protease I, Protease Mi, Protease V, Protease VI and combinations thereof. Some E. coli protease-deficient strains are available and described in, for example, Joly et ak (1998), supra; Georgiou et ak, U.S. Pat. No. 5,264,365; Georgiou et ak, U.S. Pat. No. 5,508,192; Kara et ak, Microbial Drug Resistance, 2:63-72 (1996).

In some embodiments, E. coli strains deficient for proteolytic enzymes and transformed with plasmids overexpressing one or more chaperone proteins are used as host cells in the expression system of the invention.

c. Masked Cytokine Purification

In some embodiments, the masked cytokine produced herein is further purified to obtain preparations that are substantially homogeneous for further assays and uses. Standard protein purification methods known in the art can be employed. The following procedures are exemplary of suitable purification procedures: fractionation on immunoaffinity or ion-exchange columns, ethanol precipitation, reverse phase HPLC, chromatography on silica or on a cation-exchange resin such as DEAE, chromatofocusing, SDS-PAGE, ammonium sulfate precipitation, and gel filtration using, for example, Sephadex G-75.

In some embodiments, Protein A immobilized on a solid phase is used for immunoaffinity purification of the masked cytokines of the invention. Protein A is a 41 kD cell wall protein from *Staphylococcus aureus* which binds with a high affinity to the Fc region of antibodies. Lindmark et al (1983) J. Immunol. Meth. 62:1-13. The solid phase to which Protein A is immobilized can be a column comprising a glass or silica surface, or a controlled pore glass column or a silicic acid column. In some applications, the column is coated with a reagent, such as glycerol, to possibly prevent non-specific adherence of contaminants.

As the first step of purification, a preparation derived from the cell culture as described above can be applied onto a Protein A immobilized solid phase to allow specific binding of the masked cytokine of interest to Protein A. The solid phase would then be washed to remove contaminants non-specifically bound to the solid phase. Finally, the masked cytokine of interest is recovered from the solid phase by elution. Other methods of purification that provide for high affinity binding to a component of the masked cytokine can be employed in accordance with standard protein purification methods known in the art.

2. Generating Masked Cytokines Using Eukaryotic Host Cells

A vector for use in a eukaryotic host cell generally includes one or more of the following non-limiting components: a signal sequence, an origin of replication, one or more marker genes, an enhancer element, a promoter, and a transcription termination sequence.

a. Signal Sequence Component

A vector for use in a eukaryotic host cell may also contain a signal sequence or other polypeptide having a specific cleavage site at the N-terminus of the mature protein or polypeptide of interest. The heterologous signal sequence selected may be one that is recognized and processed (i.e., cleaved by a signal peptidase) by the host cell. In mammalian cell expression, mammalian signal sequences as well as viral secretory leaders, for example, the herpes simplex gD signal, are available.

The DNA for such a precursor region is ligated in reading frame to DNA encoding the masked cytokine.

b. Origin of Replication

Generally, an origin of replication component is not needed for mammalian expression vectors. For example, the SV40 origin may typically be used only because it contains the early promoter.

c. Selection Gene Component

Expression and cloning vectors may contain a selection gene, also termed a selectable marker. Typical selection genes encode proteins that (a) confer resistance to antibiotics or other toxins, e.g., ampicillin, neomycin, methotrexate, or tetracycline, (b) complement auxotrophic deficiencies, where relevant, or (c) supply critical nutrients not available from complex media.

One example of a selection scheme utilizes a drug to arrest growth of a host cell. Those cells that are successfully transformed with a heterologous gene produce a protein conferring drug resistance and thus survive the selection regimen. Examples of such dominant selection use the drugs neomycin, mycophenolic acid and hygromycin.

Another example of suitable selectable markers for mammalian cells are those that enable the identification of cells competent to take up the masked cytokine encoding nucleic acid, such as DHFR, thymidine kinase, metallothionein-I and —II, primate metallothionein genes, adenosine deaminase, ornithine decarboxylase, etc.

For example, in some embodiments, cells transformed with the DHFR selection gene are first identified by culturing all of the transformants in a culture medium that contains methotrexate (Mtx), a competitive antagonist of DHFR. In some embodiments, an appropriate host cell when wild-type DHFR is employed is the Chinese hamster ovary (CHO) cell line deficient in DHFR activity (e.g., ATCC CRL-9096).

Alternatively, host cells (particularly wild-type hosts that contain endogenous DHFR) transformed or co-transformed with DNA sequences encoding a masked cytokine, wild-type DHFR protein, and another selectable marker such as aminoglycoside 3'-phosphotransferase (APH) can be selected by cell growth in medium containing a selection agent for the selectable marker such as an aminoglycosidic antibiotic, e.g., kanamycin, neomycin, or G418. See U.S. Pat. No. 4,965,199. Host cells may include NSO, including cell lines deficient in glutamine synthetase (GS). Methods for the use of GS as a selectable marker for mammalian cells are described in U.S. Pat. Nos. 5,122,464 and 5,891,693.

d. Promoter Component

Expression and cloning vectors usually contain a promoter that is recognized by the host organism and is operably linked to nucleic acid encoding a masked cytokine of interest, which can be any masked cytokine described herein. Promoter sequences are known for eukaryotes. For example, virtually all eukaryotic genes have an AT-rich region located approximately 25 to 30 bases upstream from the site where transcription is initiated. Another sequence found 70 to 80 bases upstream from the start of transcription of many genes is a CNCAAT region where N may be any nucleotide. At the 3' end of most eukaryotic genes is an AATAAA sequence that may be the signal for addition of the poly A tail to the 3' end of the coding sequence. In certain embodiments, any or all of these sequences may be suitably inserted into eukaryotic expression vectors.

Transcription from vectors in mammalian host cells is controlled, for example, by promoters obtained from the genomes of viruses such as polyoma virus, fowlpox virus, adenovirus (such as Adenovirus 2), bovine papilloma virus, avian sarcoma virus, cytomegalovirus, a retrovirus, hepatis-B virus and Simian Virus 40 (SV40), from heterologous mammalian promoters, e.g., the actin promoter or an immunoglobulin promoter, from heat-shock promoters, provided such promoters are compatible with the host cell systems.

The early and late promoters of the SV40 virus are conveniently obtained as an SV40 restriction fragment that also contains the SV40 viral origin of replication. The immediate early promoter of the human cytomegalovirus is conveniently obtained as a Hindlll E restriction fragment. A system for expressing DNA in mammalian hosts using the bovine papilloma virus as a vector is disclosed in U.S. Pat. No. 4,419,446. A modification of this system is described in U.S. Pat. No. 4,601,978. See also Reyes et ah, Nature 297:598-601 (1982), describing expression of human [3-interferon cDNA in murine cells under the control of a thymidine kinase promoter from herpes simplex virus. Alternatively, the Rous Sarcoma Virus long terminal repeat can be used as the promoter.

e. Enhancer Element Component

Transcription of DNA encoding a masked cytokine of this invention by higher eukaryotes is often increased by inserting an enhancer sequence into the vector. Many enhancer sequences are now known from mammalian genes (globin, elastase, albumin, a-fetoprotein, and insulin). Typically, however, one will use an enhancer from a eukaryotic cell virus. Examples include the SV40 enhancer on the late side of the replication origin (bp 100-270), the human cytomegalovirus early promoter enhancer, the murine cytomegalovirus early promoter enhancer, the polyoma enhancer on the late side of the replication origin, and adenovirus enhancers. See also Yaniv, Nature 297:17-18 (1982) (describing enhancer elements for activation of eukaryotic promoters). The enhancer may be spliced into the vector at a position 5' or 3' to the masked cytokine-encoding sequence but is generally located at a site 5' from the promoter.

f. Transcription Termination Component

Expression vectors used in eukaryotic host cells may also contain sequences necessary for the termination of transcription and for stabilizing the mRNA. Such sequences are commonly available from the 5' and, occasionally 3', untranslated regions of eukaryotic or viral DNAs or cDNAs. These regions contain nucleotide segments transcribed as polyadenylated fragments in the untranslated portion of the mRNA encoding a masked cytokine. One useful transcription termination component is the bovine growth hormone polyadenylation region. See WO94/11026 and the expression vector disclosed therein.

g. Selection and Transformation of Host Cells

Suitable host cells for cloning or expressing the DNA in the vectors herein include higher eukaryote cells described herein, including vertebrate host cells. Propagation of vertebrate cells in culture (tissue culture) has become a routine procedure. Examples of useful mammalian host cell lines are monkey kidney CV1 line transformed by SV40 (COS-7, ATCC CRL 1651); human embryonic kidney line (293 or 293 cells subcloned for growth in suspension culture, Graham et ah, J. Gen Virol. 36:59 (1977)); baby hamster kidney cells (BHK, ATCC CCL 10); Chinese hamster ovary cells/-DHFR (CHO, Urlaub et ah, Proc. Natl. Acad. Sci. USA 77:4216 (1980)); murine sertoli cells (TM4, Mather, Biol. Reprod. 23:243-251 (1980)); monkey kidney cells (CV1 ATCC CCL 70); African green monkey kidney cells (VERO-76, ATCC CRL-1587); human cervical carcinoma cells (HELA, ATCC CCL 2); canine kidney cells (MDCK, ATCC CCL 34); buffalo rat liver cells (BEL 3A, ATCC CRL 1442); human lung cells (W138, ATCC CCL 75); human liver cells (Hep G2, HB 8065); murine mammary tumor (MMT 060562, ATCC CCL51); TRI cells (Mather et ah, Annals N.Y. Acad. Sci. 383:44-68 (1982)); MRC 5 cells; FS4 cells; and a human hepatoma line (Hep G2).

Host cells are transformed with the above-described-expression or cloning vectors for masked cytokine production and cultured in conventional nutrient media modified as appropriate for inducing promoters, selecting transformants, or amplifying the genes encoding the desired sequences.

h. Culturing Host Cells

The host cells used to produce masked cytokines of this invention may be cultured in a variety of media. Commercially available media such as Ham's F10 (Sigma), Minimal Essential Medium ((MEM), Sigma), RPMI-1640 (Sigma), and Dulbecco's Modified Eagle's Medium ((DMEM), Sigma) are suitable for culturing the host cells. In addition, any of the media described in Ham et ah, Meth. Enz. 58:44 (1979), Barnes et ah, Anal. Biochem. 102:255 (1980), U.S. Pat. Nos. 4,767,704; 4,657,866; A,921,162 4,560,655; or 5,122,469; WO 90/03430; WO 87/00195; or U.S. Pat. Re. 30,985 may be used as culture media for the host cells. Any of these media may be supplemented as necessary with hormones and/or other growth factors (such as insulin, transferrin, or epidermal growth factor), salts (such as sodium chloride, calcium, magnesium, and phosphate), buffers (such as HEPES), nucleotides (such as adenosine and thymidine), antibiotics (such as GENTAMYCIN™ drug), trace elements (defined as inorganic compounds usually present at final concentrations in the micromolar range), and glucose or an equivalent energy source. Any other supplements may also be included at appropriate concentrations that would be known to those skilled in the art. The culture conditions, such as temperature, pH, and the like, are those previously used with the host cell selected for expression, and will be apparent to the ordinarily skilled artisan.

i. Purification of Masked Cytokines

When using recombinant techniques, the masked cytokines can be produced intracellularly, or directly secreted into the medium. If the masked cytokine is produced intracellularly, as a first step, the particulate debris, either host cells or lysed fragments, may be removed, for example, by centrifugation or ultrafiltration. Where the masked cytokine is secreted into the medium, supernatants from such expression systems may be first concentrated using a commercially available protein concentration filter, for example, an Amicon or Millipore Pellicon ultrafiltration unit. A protease inhibitor such as PMSF may be included in any of the foregoing steps to inhibit proteolysis, and antibiotics may be included to prevent the growth of adventitious contaminants.

The masked cytokine composition prepared from the cells can be purified using, for example, hydroxylapatite chromatography, gel electrophoresis, dialysis, and affinity chromatography, with affinity chromatography being a convenient technique. The suitability of protein A as an affinity ligand depends on the species and isotype of any immunoglobulin Fc domain, if any, that is present in the masked cytokine. Protein A can be used to purify antibodies that are based on human IgG1, IgG2, or IgG4 heavy chains (Lindmark et ak, J. Immunol. Methods 62:1-13 (1983)). Protein G is recommended for all murine isotypes and for human y3 (Guss et ak, EMBO J. 5:15671575 (1986)). The matrix to which the affinity ligand is attached may be agarose, but other matrices are available. Mechanically stable matrices such as controlled pore glass or poly(styrenedivinyl)benzene allow for faster flow rates and shorter processing times than can be achieved with agarose. Where the masked cytokine comprises a CH3 domain, the Bakerbond ABX™ resin (J. T. Baker, Phillipsburg, N.J.) is useful for purification.

Other techniques for protein purification such as fractionahon on an ion-exchange column, ethanol precipitation, Reverse Phase HPLC, chromatography on silica, chromatography on heparin SEPHAROSE™ chromatography on an anion or cation exchange resin (such as a polyaspartic acid column), chromatofocusing, SDS-PAGE, and ammonium sulfate precipitation are also available depending on the masked cytokine to be recovered.

Following any preliminary purification step(s), the mixture comprising the masked cytokine of interest and contaminants may be subjected to further purification, for example, by low pH hydrophobic interaction chromatography using an elution buffer at a pH between about 2.5-4.5, performed at low salt concentrations (e.g., from about 0-0.25M salt).

In general, various methodologies for preparing masked cytokines for use in research, testing, and clinical use are well-established in the art, consistent with the above-described methodologies and/or as deemed appropriate by one skilled in the art for a particular masked cytokine of interest.

5. Compositions

In some aspects, also provided herein are compositions comprising any of the masked cytokines described herein. In some embodiments, the composition comprises any of the exemplary embodiments of masked cytokine described herein. In some embodiments, the composition comprises a dimer of any of the masked cytokines described herein. In some embodiments, the composition is a pharmaceutical composition. In some embodiments, the composition comprises a masked cytokine and further comprises one or more of the components as described in detail below. For example, in some embodiments, the composition comprises one or more pharmaceutically acceptable carriers, excipients, stabilizers, buffers, preservatives, tonicity agents, non-ionic surfactants or detergents, or other therapeutic agents or active compounds, or combinations thereof. The various embodiments of the composition are sometimes referred to herein as formulations.

Therapeutic formulations are prepared for storage by mixing the active ingredient having the desired degree of purity with optional pharmaceutically acceptable carriers, excipients or stabilizers (Remington: The Science and Practice of Pharmacy, 20th Ed., Lippincott Williams & Wiklins, Pub., Gennaro Ed., Philadelphia, Pa. 2000). Acceptable carriers, excipients, or stabilizers are nontoxic to recipients at the dosages and concentrations employed, and include buffers, antioxidants including ascorbic acid, methionine, Vitamin E, sodium metabisulfite; preservatives, isotonicifiers, stabilizers, metal complexes (e.g. Zn-protein complexes); chelating agents such as EDTA and/or non-ionic surfactants.

Buffers can be used to control the pH in a range which optimizes the therapeutic effectiveness, especially if stability is pH dependent. Buffers can be present at concentrations ranging from about 50 mM to about 250 mM. Suitable buffering agents for use with the present invention include both organic and inorganic acids and salts thereof. For example, citrate, phosphate, succinate, tartrate, fumarate, gluconate, oxalate, lactate, acetate. Additionally, buffers may be comprised of histidine and trimethylamine salts such as Tris.

Preservatives can be added to prevent microbial growth, and are typically present in a range from about 0.2%-1.0% (w/v). Examples of suitable preservatives commonly used with therapeutics include octadecyldimethylbenzyl ammonium chloride; hexamethonium chloride; benzalkonium halides (e.g., chloride, bromide, iodide), benzethonium chloride; thimerosal, phenol, butyl or benzyl alcohol; alkyl parabens such as methyl or propyl paraben; catechol; resorcinol; cyclohexanol, 3-pentanol, m-cresol, o-cresol, p-cresol, methyl p-hydroxybenzoate, propyl p-hydroxybenzoate, 2-phenoxyethanol, butyl p-hydroxybenzoate, 2-phenylethanol, ethanol, chlorobutanol, thiomerosal, bronopol, benzoic acid, imidurea, chlorohexidine, sodium dehydroacetate, chlorocresol, ethyl p-hydroxybenzoate, and chlorphenesine (3p-chlorphenoxypropane-1,2-diol).

Tonicity agents, sometimes known as "stabilizers" can be present to adjust or maintain the tonicity of liquid in a composition. When used with large, charged biomolecules such as proteins and antibodies, they are often termed "stabilizers" because they can interact with the charged groups of the amino acid side chains, thereby lessening the potential for inter and intra-molecular interactions.

Tonicity agents can be present in any amount between about 0.1% to about 25% by weight or between about 1 to about 5% by weight, taking into account the relative amounts of the other ingredients. In some embodiments, tonicity agents include polyhydric sugar alcohols, trihydric or higher sugar alcohols, such as glycerin, erythritol, arabitol, xylitol, sorbitol and mannitol.

Additional excipients include agents which can serve as one or more of the following: (1) bulking agents, (2) solubility enhancers, (3) stabilizers and (4) and agents preventing denaturation or adherence to the container wall. Such excipients include: polyhydric sugar alcohols (enumerated above); amino acids such as alanine, glycine, glutamine, asparagine, histidine, arginine, lysine, ornithine, leucine, 2-phenylalanine, glutamic acid, threonine, etc.; organic sugars or sugar alcohols such as sucrose, lactose, lactitol, trehalose, stachyose, mannose, sorbose, xylose, ribose, ribitol, myoinisitose, myoinisitol, galactose, galactitol, glycerol, cyclitols (e.g., inositol), polyethylene glycol; sulfur containing reducing agents, such as urea, glutathione, thioctic acid, sodium thioglycolate, thioglycerol, a-monothioglycerol and sodium thio sulfate; low molecular weight proteins such as human serum albumin, bovine serum albumin, gelatin or other immunoglobulins; hydrophilic polymers such as polyvinylpyrrolidone; monosaccharides (e.g., xylose, mannose, fructose, glucose; disaccharides (e.g., lactose, maltose, sucrose); trisaccharides such as raffinose; and polysaccharides such as dextrin or dextran.

Non-ionic surfactants or detergents (also known as "wetting agents") can be present to help solubilize the therapeutic agent as well as to protect the therapeutic protein against agitation-induced aggregation, which also permits the formulation to be exposed to shear surface stress without causing denaturation of the active therapeutic protein or antibody. Non-ionic surfactants are present in a range of about 0.05 mg/ml to about 1.0 mg/ml or about 0.07 mg/ml to about 0.2 mg/ml. In some embodiments, non-ionic surfactants are present in a range of about 0.001% to about 0.1% w/v or about 0.01% to about 0.1% w/v or about 0.01% to about 0.025% w/v.

Suitable non-ionic surfactants include polysorbates (20, 40, 60, 65, 80, etc.), polyoxamers (184, 188, etc.), PLURONIC® polyols, TRITON®, polyoxyethylene sorbitan monoethers (TWEEN®-20, TWEEN®-80, etc.), lauromacrogol 400, polyoxyl 40 stearate, polyoxyethylene hydrogenated castor oil 10, 50 and 60, glycerol monostearate, sucrose fatty acid ester, methyl celluose and carboxymethyl cellulose. Anionic detergents that can be used include sodium lauryl sulfate, dioctyle sodium sulfosuccinate and dioctyl sodium sulfonate. Cationic detergents include benzalkonium chloride or benzethonium chloride.

In order for the formulations to be used for in vivo administration, they must be sterile. The formulation may be rendered sterile by filtration through sterile filtration membranes. The therapeutic compositions herein generally are placed into a container having a sterile access port, for example, an intravenous solution bag or vial having a stopper pierceable by a hypodermic injection needle.

The route of administration is in accordance with known and accepted methods, such as by single or multiple bolus or infusion over a long period of time in a suitable manner, e.g., injection or infusion by subcutaneous, intravenous, intraperitoneal, intramuscular, intraarterial, intralesional or intraarticular routes, topical administration, inhalation or by sustained release or extended-release means.

Any of the masked cytokines described herein can be used alone or in combination with other therapeutic agents such is in the methods described herein. The term "in combination with" encompasses two or more therapeutic agents (e.g., a masked cytokine and a therapeutic agent) that are included in the same or separate formulations. In some embodiments, "in combination with" refers to "simultaneous" administration, in which case administration of the masked cytokine of the invention occurs simultaneously to the administration of the one or more additional therapeutic agents (e.g., at the same time or within one hour between administration (s) of the masked cytokine and administration of the one or more additional therapeutic agents). In some embodiments, "in combination with" refers to sequential administration, in which case administration of the masked cytokine of the invention occurs prior to and/or following, administration of the one or more additional therapeutic agents (e.g., greater than one hour between administration (s) of the masked cytokine and administration of the one or more additional therapeutic agents). Agents contemplated herein include, but are not limited to, a cytotoxic agent, a cytokine, an agent targeting an immune checkpoint molecule, an agent targeting an immune stimulatory molecule, a growth inhibitory agent, an immune stimulatory agent, an anti-inflammatory agent, or an anti-cancer agent.

The formulation herein may also contain more than one active compound as necessary for the particular indication being treated, preferably those with complementary activities that do not adversely affect each other. Alternatively, or in addition, the composition may comprise a cytotoxic agent, cytokine, agent targeting an immune checkpoint molecule or stimulatory molecule, growth inhibitory agent, an immune stimulatory agent, an anti-inflammatory agent, or an anti-cancer agent. Such molecules are suitably present in combination in amounts that are effective for the purpose intended.

The formulation may be presented in any suitable state, such as a liquid formulation, a solid state (lyophilized) formulation, or a frozen formulation. Approaches for preparing each of these types of formulations for therapeutic use are well known in the art.

6. Methods of Treatment

Provided herein are methods for treating or preventing a disease in a subject comprising administering to the subject an effective amount of any masked cytokine described herein or compositions thereof. In some embodiments, methods are provided for treating or preventing a disease in a subject comprising administering to the subject any composition described herein. In some embodiments, the subject (e.g., a human patient) has been diagnosed with cancer or is at risk of developing such a disorder. In some embodiments, methods are provided for treating or preventing disease in a subject comprising administering to the subject an effective amount of any masked cytokine described herein or compositions thereof, wherein the masked cytokine is activated upon cleavage by an enzyme. In some embodiments, the masked cytokine is activated at a tumor microenvironment. The masked cytokine is therapeutically active after it has cleaved. Thus, in some embodiments, the active agent is the cleavage product.

For the prevention or treatment of disease, the appropriate dosage of an active agent will depend on the type of disease to be treated, as defined herein, the severity and course of the disease, whether the agent is administered for preventive or therapeutic purposes, previous therapy, the subject's clinical history and response to the agent, and the discretion of the attending physician. The agent is suitably administered to the subject at one time or over a series of treatments.

In some embodiments, the protease acting to cleave the proteolytically cleavable peptide is an MMP. In some embodiments of the methods described herein, an interval between administrations of a masked cytokine described herein is about one week or longer. In some embodiments of the methods described herein, an interval between administrations of a masked cytokine described herein is about two days or longer, about three days or longer, about four days or longer, about five days or longer, or about six days or longer. In some embodiments of the methods described herein, an interval between administrations of a masked cytokine described herein is about one week or longer, about two weeks or longer, about three weeks or longer, or about four weeks or longer. In some embodiments of the methods described herein, an interval between administrations of a masked cytokine described herein is about one month or longer, about two months or longer, or about three months or longer. As used herein, an interval between administrations refers to the time period between one administration of the masked cytokine and the next administration of the masked cytokine. As used herein, an interval of about one month includes four weeks. In some embodiments, the treatment includes multiple administrations of the masked cytokine, wherein the interval between administrations may vary. For example, in some embodiments, the interval between the first administration and the second administration is about one week, and the intervals between the subsequent administrations are about two weeks. In some embodiments, the interval between the first administration and the second administration is about two days, three days, four days, or five days, or six days, and the intervals between the subsequent administrations are about one week.

In some embodiments, the masked cytokine is administered on multiple occasions over a period of time. The dosage that is administered to the subject on multiple occasions can, in some embodiments, be the same dosage for each administration, or, in some embodiments, the masked cytokine can be administered to the subject at two or more different dosages. For example, in some embodiments, a masked cytokine is initially administered at one dosage on one or more occasions and is later administered at a second dosage on one or more occasions beginning at a later time point.

In some embodiments, a masked polypeptide described herein is administered at a flat dose. In some embodiments, a masked polypeptide described herein is administered to a subject at a dosage from about 25 mg to about 500 mg per dose. In some embodiments, the masked polypeptide is administered to a subject at a dosage of about 25 mg to about 50 mg, about 50 mg to about 75 mg, about 75 mg to about 100 mg, about 100 mg to about 125 mg, about 125 mg to about 150 mg, about 150 mg to about 175 mg, about 175 mg to about 200 mg, about 200 mg to about 225 mg, about 225 mg to about 250 mg, about 250 mg to about 275 mg, about 275 mg to about 300 mg, about 300 mg to about 325 mg, about 325 mg to about 350 mg, about 350 mg to about 375 mg, about 375 mg to about 400 mg, about 400 mg to about 425 mg, about 425 mg to about 450 mg, about 450 mg, to about 475 mg, or about 475 mg to about 500 mg per dose.

In some embodiments, a masked polypeptide described herein is administered to a subject at a dosage based on the subject's weight or body surface area (BSA). Depending on the type and severity of the disease, about 1 μg/kg to 15 mg/kg (e.g. 0.1 mg/kg-10 mg/kg) of masked polypeptide can be an initial candidate dosage for administration to the patient, whether, for example, by one or more separate administrations, or by continuous infusion. One typical daily dosage might range from about 1 μg/kg to 100 mg/kg or more, depending on the factors mentioned above. For repeated administrations over several days or longer, depending on the condition, the treatment would generally be sustained until a desired suppression of disease symptoms occurs. One exemplary dosage of the masked polypeptide would be in the range from about 0.05 mg/kg to about 10 mg/kg. Thus, one or more doses of about 0.5 mg/kg, 2.0 mg/kg, 4.0 mg/kg or 10 mg/kg (or any combination thereof) may be administered to the patient. In some embodiments, a masked polypeptide described herein is administered to a subject at a dosage from about 0.1 mg/kg to about 10 mg/kg or about 1.0 mg/kg to about 10 mg/kg. In some embodiments, a masked polypeptide described herein is administered to a subject at a dosage of about any of 0.1 mg/kg, 0.5 mg/kg, 1.0 mg/kg, 1.5 mg/kg, 2.0 mg/kg, 2.5 mg/kg, 3.0 mg/kg, 3.5 mg/kg, 4.0 mg/kg, 4.5 mg/kg, 5.0 mg/kg, 5.5 mg/kg, 6.0 mg/kg, 6.5 mg/kg, 7.0 mg/kg, 7.5 mg/kg, 8.0 mg/kg, 8.5 mg/kg, 9.0 mg/kg, 9.5 mg/kg, or 10.0 mg/kg. In some embodiments, a masked polypeptide described herein is administered to a subject at a dosage of about or at least about 0.1 mg/kg, about or at least about 0.5 mg/kg, about or at least about 1.0 mg/kg, about or at least about 1.5 mg/kg, about or at least about 2.0 mg/kg, about or at least about 2.5 mg/kg, about or at least about 3.0 mg/kg, about or at least about 3.5 mg/kg, about or at least about 4.0 mg/kg, about or at least about 4.5 mg/kg, about or at least about 5.0 mg/kg, about or at least about 5.5 mg/kg, about or at least about 6.0 mg/kg, about or at least about 6.5 mg/kg, about or at least about 7.0 mg/kg, about or at least about 7.5 mg/kg, about or at least about 8.0 mg/kg, about or at least about 8.5 mg/kg, about or at least about 9.0 mg/kg, about or at least about 9.5 mg/kg, about or at least about 10.0 mg/kg, about or at least about 15.0 mg/kg, about or at least about 20 mg/kg, about or at least about 30 mg/kg, about or at least about 40 mg/kg, about or at least about 50 mg/kg, about or at least about 60 mg/kg, about or at least about 70 mg/kg, about or at least about 80 mg/kg, about or at least about 90 mg/kg, or about or at least about 100 mg/kg. Any of the dosing frequencies described above may be used.

A method of treatment contemplated herein is the treatment of a disorder or disease such as cancer with any of the masked cytokines or compositions described herein. Disorders or diseases that are treatable with the formulations of this present invention include leukemia, lymphoma, head and neck cancer, colorectal cancer, prostate cancer, pancreatic cancer, melanoma, breast cancer, neuroblastoma, lung cancer, ovarian cancer, osteosarcoma, bladder cancer, cervical cancer, liver cancer, kidney cancer, skin cancer (e.g., Merkel cell carcinoma) or testicular cancer.

In some embodiments, provided herein is a method of treatment or prevention of a cancer by administration of any masked cytokines or compositions described herein. In some embodiments, provided herein is a method of treatment or prevention of a cancer by administration of any masked cytokine or composition described herein in combination with an anticancer agent. The anti-cancer agent can be any agent capable of reducing cancer growth, interfering with cancer cell replication, directly or indirectly killing cancer cells, reducing metastasis, reducing tumor blood supply, or reducing cell survival. In some embodiments, the anti-cancer agent is selected from the group consisting of a PD-1 inhibitor, an EGFR inhibitor, a HER2 inhibitor, a VEGFR inhibitor, a CTLA-4 inhibitor, a BTLA inhibitor, a B7H4 inhibitor, a B7H3 inhibitor, a CSFIR inhibitor, an HVEM inhibitor, a CD27 inhibitor, a KIR inhibitor, an NKG2A inhibitor, an NKG2D agonist, a TWEAK inhibitor, an ALK inhibitor, a CD52 targeting antibody, a CCR4 targeting antibody, a PD-L1 inhibitor, a KIT inhibitor, a PDGFR inhibitor, a BAFF inhibitor, an HD AC inhibitor, a VEGF ligand inhibitor, a CD19 targeting molecule, a FOFR1 targeting molecule, a DFF3 targeting molecule, a DKK1 targeting molecule, a MUC1 targeting molecule, a MUG 16 targeting molecule, a PSMA targeting molecule, an MSFN targeting molecule, an NY-ESO-1 targeting molecule, a B7H3 targeting molecule, a B7H4 targeting molecule, a BCMA targeting molecule, a CD29 targeting molecule, a CD151targeting molecule, a CD 123 targeting molecule, a CD33 targeting molecule, a CD37 targeting molecule, a CDH19 targeting molecule, a CEA targeting molecule, a Claudin 18.2 targeting molecule, a CFECi2A targeting molecule, an EGFRVIII targeting molecule, an EPCAM targeting molecule, an EPHA2 targeting molecule, an FCRHS targeting molecule, an FLT3 targeting molecule, a GD2 targeting molecule, a glypican 3 targeting molecule, a gpA33 targeting molecule, a GPRCSD targeting molecule, an IL-23R targeting molecule, an IL-1RAP targeting molecule, a MCSP targeting molecule, a RON targeting molecule, a ROR1 targeting molecule, a STEAP2 targeting molecule, a TfR targeting molecule, a CD166 targeting molecule, a TPBG targeting molecule, a TROP2 targeting molecule, a proteasome inhibitor, an ABE inhibitor, a CD30 inhibitor, a FLT3 inhibitor, a MET inhibitor, a RET inhibitor, an IL-1 (3 inhibitor, a MEK inhibitor, a ROS1 inhibitor, a BRAE inhibitor, a CD38 inhibitor, a RANKE inhibitor, a B4GALNT1 inhibitor, a SLAMF7 inhibitor, an IDH2 inhibitor, an mTOR inhibitor, a CD20 targeting antibody, a BTK inhibitor, a PI3K inhibitor, a FLT3 inhibitor, a PARP inhibitor, a CDK4 inhibitor, a CDK6 inhibitor, an EGFR inhibitor, a RAF inhibitor, a JAK1 inhibitor, a JAK2 inhibitor, a JAK3 inhibitor, an IL-6 inhibitor, a IL-17 inhibitor, a Smoothened inhibitor, an IL-6R inhibitor, a BCL2 inhibitor, a PTCH inhibitor, a PIGF inhibitor, a TGFB inhibitor, a CD28 agonist, a CD3 agonist, CD40 agonist, a GITR agonist, a 0X40 agonist, a VISTA agonist, a CD137 agonist, a LAG3 inhibitor, a TIM3 inhibitor, a TIGIT inhibitor, and an IL-2R inhibitor.

In some embodiments, provided herein is a method of treatment or prevention of a cancer by administration of any masked cytokine described herein in combination with an anti-inflammatory agent. The anti-inflammatory agent can be any agent capable of preventing, counteracting, inhibiting, or otherwise reducing inflammation.

In some embodiments, the anti-inflammatory agent is a cyclooxygenase (COX) inhibitor. The COX inhibitor can be any agent that inhibits the activity of COX-1 and/or COX-2. In some embodiments, the COX inhibitor selectively inhibits COX-1 (i.e., the COX inhibitor inhibits the activity of COX-1 more than it inhibits the activity of COX-2). In some embodiments, the COX inhibitor selectively inhibits COX-2 (i.e., the COX inhibitor inhibits the activity of COX-2 more than it inhibits the activity of COX-1). In some embodiments, the COX inhibitor inhibits both COX-1 and COX-2.

In some embodiments, the COX inhibitor is a selective COX-1 inhibitor and is selected from the group consisting of SC-560, FR122047, P6, mofezolac, TFAP, flurbiprofen, and ketoprofen. In some embodiments, the COX inhibitor is a selective COX-2 inhibitor and is selected from the group consisting of celecoxib, rofecoxib, meloxicam, piroxicam, deracoxib, parecoxib, valdecoxib, etoricoxib, a chromene derivative, a chroman derivative, N-(2-cyclohexyloxynitrophenyl) methane sulfonamide, parecoxib, lumiracoxib, RS 57067, T-614, BMS-347070, JTE-522, S-2474, SVT-2016, CT-3, ABT-963, SC-58125, nimesulide, flosulide, NS-398, L-745337, RWJ-63556, L-784512, darbufelone, CS-502, LAS-34475, LAS-34555, S-33516, diclofenac, mefenamic acid, and SD-8381. In some embodiments, the COX inhibitor is selected from the group consisting of ibuprofen, naproxen, ketorolac, indomethacin, aspirin, naproxen, tolmetin, piroxicam, and meclofenamate. In some embodiments, the COX inhibitor is selected from the group consisting of SC-560, FR122047, P6, mofezolac, TFAP, flurbiprofen, ketoprofen, celecoxib, rofecoxib, meloxicam, piroxicam, deracoxib, parecoxib, valdecoxib, etoricoxib, a chromene derivative, a chroman derivative, N-(2-cyclohexyloxynitrophenyl) methane sulfonamide, parecoxib, lumiracoxib, RS 57067, T-614, BMS-347070, JTE-522, S-2474, SVT-2016, CT-3, ABT-963, SC-58125, nimesulide, flosulide, NS-398, L-745337, RWJ-63556, L-784512, darbufelone, CS-502, LAS-34475, LAS-34555, S-33516, diclofenac, mefenamic acid, SD-8381, ibuprofen, naproxen, ketorolac, indomethacin, aspirin, naproxen, tolmetin, piroxicam, and meclofenamate.

In some embodiments, the anti-inflammatory agent is an NF-kB inhibitor. The NF-kB inhibitor can be any agent that inhibits the activity of the NF-kB pathway. In some embodiments, the NF-kB inhibitor is selected from the group consisting of an IKK complex inhibitor, an IkB degradation inhibitor, an NF-kB nuclear translocation inhibitor, a p65 acetylation inhibitor, an NF-kB DNA binding inhibitor, an NF-kB transactivation inhibitor, and a p53 induction inhibitor.

In some embodiments, the IKK complex inhibitor is selected from the group consisting of TPCA-1, NF-kB Activation Inhibitor VI (BOT-64), BMS-345541, amlexanox, SC-514 (GK-01140), IMD-0354, and IKK-16. In some embodiments, the IkB degradation inhibitor is selected from the group consisting of BAY-11-7082, MG-115, MG-132, lactacystin, epoxomicin, parthenolide, carfilzomib, and MLN-4924 (pevonedistat). In some embodiments, the NF-kB nuclear translocation inhibitor is selected from the group consisting of JSH-23 and rolipram. In some embodiments, the p65 acetylation inhibitor is selected from the group consisting of gallic acid and anacardic acid. In some embodiments, the NF-kB DNA binding inhibitor is selected from the group consisting of GYY-4137, p-XSC, CV-3988, and prostaglandin E2 (PGE2). In some embodiments, the NF-kB transactivation inhibitor is selected from the group consisting of LY-294002, wortmannin, and mesalamine. In some embodiments, the p53 induction inhibitor is selected from the group consisting of quinacrine and flavopiridol. In some embodiments, the NF-kB inhibitor is selected from the group consisting of TPCA-1, NF-kB Activation Inhibitor VI (BOT-64), BMS-345541, amlexanox, SC-514 (GK-01140), IMD-0354, IKK-16, BAY-11-7082, MG-115, MG-132, lactacystin, epoxomicin, parthenolide, carfilzomib, MLN-4924 (pevonedistat), JSH-23 rolipram, gallic acid, anacardic acid, GYY-4137, p-XSC, CV-3988, prostaglandin E2 (PGE2), LY-294002, wortmannin, mesalamine, quinacrine, and flavopiridol.

In some embodiments, provided herein is a method of treatment or prevention of a cancer by administration of any masked cytokine or composition described herein in combination with an anticancer therapeutic protein. The anticancer therapeutic protein can be any therapeutic protein capable of reducing cancer growth, interfering with cancer cell replication, directly or indirectly killing cancer cells, reducing metastasis, reducing tumor blood supply, or reducing cell survival. Exemplary anti-cancer therapeutic proteins may come in the form of an antibody or fragment thereof, an antibody derivative, a bispecific antibody, a chimeric antigen receptor (CAR) T cell, a fusion protein, or a bispecific T-cell engager (BiTE). In some embodiments, provided herein is a method of treatment or prevention of a cancer by administration of any masked cytokine or composition described herein in combination with CAR-NK (Natural Killer) cells.

7. Articles of Manufacture or Kits

In another aspect, an article of manufacture or kit is provided which comprises any masked cytokine described herein. The article of manufacture or kit may further comprise instructions for use of the cytokines in the methods of the invention. Thus, in certain embodiments, the article of manufacture or kit comprises instructions for the use of a masked cytokine in methods for treating or preventing a disorder (e.g., a cancer) in an individual comprising administering to the individual an effective amount of a masked cytokine. For example, in certain embodiments, the article of manufacture or kit comprises instructions for the use of a masked polypeptide in methods for treating or preventing a disorder (e.g., a cancer) in an individual comprising administering to the individual an effective amount of a masked polypeptide. In certain embodiments, the individual is a human. In some embodiments, the individual has a disease selected from the group consisting of include leukemia, lymphoma, head and neck cancer, colorectal cancer, prostate cancer, pancreatic cancer, melanoma, breast cancer, neuroblastoma, lung cancer, ovarian cancer, osteosarcoma, bladder cancer, cervical cancer, liver cancer, kidney cancer, skin cancer or testicular cancer.

The article of manufacture or kit may further comprise a container. Suitable containers include, for example, bottles, vials (e.g., dual chamber vials), syringes (such as single or dual chamber syringes), test tubes, and intravenous (IV) bags. The container may be formed from a variety of materials such as glass or plastic. The container holds the formulation. In some embodiments, the formulation is a lyophilized formulation. In some embodiments, the formulation is a frozen formulation. In some embodiments, the formulation is a liquid formulation.

The article of manufacture or kit may further comprise a label or a package insert, which is on or associated with the container, may indicate directions for reconstitution and/or use of the formulation. The label or package insert may further indicate that the formulation is useful or intended for subcutaneous, intravenous, or other modes of administration for treating or preventing a disorder (e.g., a cancer) in an individual. The container holding the formulation may be a single-use vial or a multi-use vial, which allows for repeat administrations of the reconstituted formulation. The article of manufacture or kit may further comprise a second container comprising a suitable diluent. The article of manufacture or kit may further include other materials desirable from a commercial, therapeutic, and user standpoint, including other buffers, diluents, filters, needles, syringes, and package inserts with instructions for use.

In a specific embodiment, the present invention provides kits for a single dose-administration unit. Such kits comprise a container of an aqueous formulation of therapeutic cytokine, including both single or multi-chambered pre-filled syringes. Exemplary pre-filled syringes are available from Vetter GmbH, Ravensburg, Germany.

The article of manufacture or kit herein optionally further comprises a container comprising a second medicament, wherein the masked cytokine is a first medicament, and which article or kit further comprises instructions on the label or package insert for treating the subject with the second medicament, in an effective amount.

In another embodiment, provided herein is an article of manufacture or kit comprising the formulations described herein for administration in an auto-injector device. An auto-injector can be described as an injection device that upon activation, will deliver its contents without additional necessary action from the patient or administrator. They are particularly suited for self-medication of therapeutic formulations when the delivery rate must be constant and the time of delivery is greater than a few moments.

8. Definitions

Unless defined otherwise, all terms of art, notations and other technical and scientific terms or terminology used herein are intended to have the same meaning as is commonly understood by one of ordinary skill in the art to which the claimed subject matter pertains. In some cases, terms with commonly understood meanings are defined herein for clarity and/or for ready reference, and the inclusion of such definitions herein should not necessarily be construed to represent a substantial difference over what is generally understood in the art.

It is to be understood that this invention is not limited to particular compositions or biological systems, which can, of course, vary. It is also to be understood that the terminology used herein is for the purpose of describing particular embodiments only, and is not intended to be limiting. As used in this specification and the appended claims, the singular forms "a," "an," and "the" include plural referents unless the content clearly dictates otherwise.

The term "about" as used herein refers to the usual error range for the respective value readily known to the skilled person in this technical field. Reference to "about" a value or parameter herein includes (and describes) embodiments that are directed to that value or parameter per se.

It is understood that aspects and embodiments of the invention described herein include "comprising," "consisting," and "consisting essentially of" aspects and embodiments.

As used herein, the term "and/or" refers to any one of the items, any combination of the items, or all of the items with which the term is associated. For instance, the phrase "A, B, and/or C" is intended to encompass each of the following embodiments: A, B, and C; A, B, or C; A or B; A or C; B or C; A and B; A and C; B and C; A and B or C; B and A or C; C and A or B; A (alone); B (alone); and C (alone).

The term "antibody" includes polyclonal antibodies, monoclonal antibodies (including full length antibodies which have an immunoglobulin Fc region), antibody compositions with polyepitopic specificity, multispecific antibodies (e.g., bispecific antibodies, diabodies, and single-chain molecules, as well as antibody fragments (e.g., Fab, F(ab')2, and Fv). The term "immunoglobulin" (Ig) is used interchangeably with "antibody" herein.

The term "diabodies" refers to small antibody fragments with two antigen-binding sites, which comprise a heavy chain variable (VH) domain connected to a light chain variable (VL) domain in the same polypeptide chain (VH-VL).

The basic 4-chain antibody unit is a heterotetrameric glycoprotein composed of two identical light (L) chains and two identical heavy (H) chains. An IgM antibody consists of 5 of the basic heterotetramer units along with an additional polypeptide called a J chain, and contains 10 antigen binding sites, while IgA antibodies comprise from 2-5 of the basic 4-chain units which can polymerize to form polyvalent assemblages in combination with the J chain. In the case of IgGs, the 4-chain unit is generally about 150,000 daltons. Each L chain is linked to an H chain by one covalent disulfide bond, while the two H chains are linked to each other by one or more disulfide bonds depending on the H chain isotype. Each H and L chain also has regularly spaced intrachain disulfide bridges. Each H chain has at the N-terminus, a variable domain (VH) followed by three constant domains (CH) for each of the α and y chains and four CH domains for p and s isotypes. Each L chain has at the N-terminus, a variable domain (VL) followed by a constant domain at its other end. The VL is aligned with the VH and the CL is aligned with the first constant domain of the heavy chain (CHI). Particular amino acid residues are believed to form an interface between the light chain and heavy chain variable domains. The pairing of a VH and VL together forms a single antigen-binding site. For the structure and properties of the different classes of antibodies, see e.g., Basic and Clinical Immunology, 8th Edition, Daniel P. Sties, Abba I. Terr and Tristram G. Parsolw (eds), Appleton & Lange, Norwalk, CT, 1994, page 71 and Chapter 6.

The L chain from any vertebrate species can be assigned to one of two clearly distinct types, called kappa and lambda, based on the amino acid sequences of their constant domains. Depending on the amino acid sequence of the constant domain of their heavy chains (CH), immunoglobulins can be assigned to different classes or isotypes. There are five classes of immunoglobulins: IgA, IgD, IgE, IgG and IgM, having heavy chains designated a, 8, e, y and p, respectively. The γ and a classes are further divided into subclasses on the basis of relatively minor differences in the CH sequence and function, e.g., humans express the following subclasses: IgG1, IgG2, IgG3, IgG4, IgA1 and IgA2. IgG1 antibodies can exist in multiple polymorphic variants termed allotypes (reviewed in Jefferis and Lefranc 2009. mAbs Vol 1 Issue 4 1-7) any of which are suitable for use in the invention. Common allotypic variants in human populations are those designated by the letters a,f,n,z.

An "isolated" antibody is one that has been identified, separated and/or recovered from a component of its production environment (e.g., naturally or recombinantly). In some embodiments, the isolated polypeptide is free of association with all other components from its production environment. Contaminant components of its production environment, such as that resulting from recombinant transfected cells, are materials that would typically interfere with research, diagnostic or therapeutic uses for the antibody, and may include enzymes, hormones, and other proteinaceous or non-proteinaceous solutes. In some embodiments, the polypeptide is purified: (1) to greater than 95% by weight of antibody as determined by, for example, the Lowry method, and in some embodiments, to greater than 99% by weight; (1) to a degree sufficient to obtain at least 15 residues of N-terminal or internal amino acid sequence by use of a spinning cup sequenator, or (3) to homogeneity by SDS-PAGE under non-reducing or reducing conditions using Coomassie blue or silver stain. Isolated antibody includes the antibody in situ within recombinant cells since at least one component of the antibody's natural environment will not be present. Ordinarily, however, an isolated polypeptide or antibody is prepared by at least one purification step.

The term "monoclonal antibody" as used herein refers to an antibody obtained from a population of substantially homogeneous antibodies, i.e., the individual antibodies comprising the population are identical except for possible naturally occurring mutations and/or post-translation modifications (e.g., isomerizations, amidations) that may be present in minor amounts. In some embodiments, monoclonal antibodies have a C-terminal cleavage at the heavy chain and/or light chain. For example, 1, 2, 3, 4, or 5 amino acid residues are cleaved at the C-terminus of heavy chain and/or light chain. In some embodiments, the C-terminal cleavage removes a C-terminal lysine from the heavy chain. In some embodiments, monoclonal antibodies have an N-terminal cleavage at the heavy chain and/or light chain. For example, 1, 2, 3, 4, or 5 amino acid residues are cleaved at the N-terminus of heavy chain and/or light chain. In some embodiments truncated forms of monoclonal antibodies can be made by recombinant techniques. In some embodiments, monoclonal antibodies are highly specific, being directed against a single antigenic site. In some embodiments, monoclonal antibodies are highly specific, being directed against multiple antigenic sites (such as a bispecific antibody or a multispecific antibody). The modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by a variety of techniques, including, for example, the hybridoma method, recombinant DNA methods, phage-display technologies, and technologies for producing human or human-like antibodies in animals that have parts or all of the human immunoglobulin loci or genes encoding human immunoglobulin sequences.

The terms "full-length antibody," "intact antibody" or "whole antibody" are used interchangeably to refer to an antibody in its substantially intact form, as opposed to an antibody fragment. Specifically, whole antibodies include those with heavy and light chains including an Fc region. The constant domains may be native sequence constant domains (e.g., human native sequence constant domains) or amino acid sequence variants thereof. In some cases, the intact antibody may have one or more effector functions.

An "antibody fragment" comprises a portion of an intact antibody, such as the antigen binding region and/or the variable region of the intact antibody, and/or the constant region of the intact antibody. Examples of an antibody fragment include the Fc region of the antibody, a portion of the Fc region, or a portion of the antibody comprising the Fc region. Examples of antigen-binding antibody fragments include domain antibodies (dAbs), Fab, Fab', F(ab')2 and Fv fragments; diabodies; linear antibodies (see U.S. Pat. No. 5,641,870, Example 2; Zapata et ah, Protein Eng. 8(10): 1057-1062 [1995]); single-chain antibody molecules, and multispecific antibodies formed from antibody fragments. Single heavy chain antibodies or single light chain antibodies can be engineered, or in the case of the heavy chain, can be isolated from camelids, shark, libraries or mice engineered to produce single heavy chain molecules.

Papain digestion of antibodies produced two identical antigen-binding fragments, called "Fab" fragments, and a residual "Fc" fragment, a designation reflecting the ability to crystallize readily. The Fab fragment consists of an entire L chain along with the variable region domain of the H chain (VH), and the first constant domain of one heavy chain (CHI). Each Fab fragment is monovalent with respect to antigen binding, i.e., it has a single antigen-binding site. Pepsin treatment of an antibody yields a single large F(ab')2 fragment which roughly corresponds to two disulfide linked Fab fragments having different antigen-binding activity and is still capable of cross-linking antigen. Fab' fragments differ from Fab fragments by having a few additional residues at the carboxy terminus of the CHI domain including one or more cysteines from the antibody hinge region. Fab'-SH is the designation herein for Fab' in which the cysteine residue (s) of the constant domains bear a free thiol group. F(ab')2 antibody fragments originally were produced as pairs of Fab' fragments which have hinge cysteines between them. Other chemical couplings of antibody fragments are also known. The Fc fragment comprises the carboxy-terminal portions of both H chains held together by disulfides. The effector functions of antibodies are determined by sequences and glycan in the Fc region, the region which is also recognized by Fc receptors (FcR) found on certain types of cells.

"Percent (%) amino acid sequence identity" with respect to a reference polypeptide sequence is defined as the percentage of amino acid residues in a candidate sequence that are identical with the amino acid residues in the reference polypeptide sequence, after aligning the sequences and introducing gaps, if necessary, to achieve the maximum percent sequence identity, and not considering any conservative substitutions part of the sequence identity. Alignment for purposes of determining percent amino acid sequence identity can be achieved in various ways that are within the skill in the art, for instance, using publicly available computer software such as BLAST, BLAST-2, ALIGN or Mega-lign (DNASTAR) software. Those skilled in the art can determine appropriate parameters for aligning sequences, including any algorithms needed to achieve maximal alignment over the full length of the sequences being compared. For example, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

$$100 \text{ times the fraction } X/Y$$

where X is the number of amino acid residues scored as identical matches by the sequence in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A.

Antibody "effector functions" refer to those biological activities attributable to the Fc region (a native sequence Fc region or amino acid sequence variant Fc region) of an antibody, and vary with the antibody isotype. Examples of antibody effector functions include: C1q binding and complement dependent cytotoxicity; Fc receptor binding; antibody-dependent cell-mediated cytotoxicity (ADCC); phagocytosis; down regulation of cell surface receptors (e.g., B cell receptors); and B cell activation.

"Binding affinity" as used herein refers to the strength of the non-covalent interactions between a single binding site of a molecule (e.g., a cytokine) and its binding partner (e.g., a cytokine receptor). In some embodiments, the affinity of a binding protein (e.g., a cytokine) can generally be represented by a dissociation constant (Kd). Affinity can be measured by common methods known in the art, including those described herein.

An "isolated" nucleic acid molecule encoding the cytokine polypeptides described herein is a nucleic acid molecule that is identified and separated from at least one contaminant nucleic acid molecule with which it is ordinarily associated in the environment in which it was produced. In some embodiments, the isolated nucleic acid is free of association with all components associated with the production environment. The isolated nucleic acid molecules encoding the polypeptides and cytokine polypeptides herein is in a form other than in the form or setting in which it is found in nature. Isolated nucleic acid molecules therefore are distinguished from nucleic acid encoding the polypeptides and cytokine polypeptides herein existing naturally in cells.

The term "pharmaceutical formulation" refers to a preparation that is in such form as to permit the biological activity of the active ingredient to be effective, and that contains no additional components that are unacceptably toxic to a subject to which the formulation would be administered. Such formulations are sterile.

"Carriers" as used herein include pharmaceutically acceptable carriers, excipients, or stabilizers that are nontoxic to the cell or mammal being exposed thereto at the dosages and concentrations employed. Often the physiologically acceptable carrier is an aqueous pH buffered solution. Examples of physiologically acceptable carriers include buffers such as phosphate, citrate, and other organic acids; antioxidants including ascorbic acid; low molecular weight (less than about 10 residues) polypeptide; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN™, polyethylene glycol (PEG), and PLURONICS™.

As used herein, the term "treatment" refers to clinical intervention designed to alter the natural course of the individual or cell being treated during the course of clinical pathology. Desirable effects of treatment include decreasing the rate of disease progression, ameliorating or palliating the disease state, and remission or improved prognosis. An individual is successfully "treated", for example, if one or more symptoms associated with a disorder (e.g., a neoplastic disease) are mitigated or eliminated. For example, an individual is successfully "treated" if treatment results in increasing the quality of life of those suffering from a disease, decreasing the dose of other medications required for treating the disease, reducing the frequency of recurrence of the disease, lessening severity of the disease, delaying the development or progression of the disease, and/or prolonging survival of individuals.

As used herein, "in conjunction with" or "in combination with" refers to administration of one treatment modality in addition to another treatment modality. As such, "in conjunction with" or "in combination with" refers to administration of one treatment modality before, during or after administration of the other treatment modality to the individual.

As used herein, the term "prevention" includes providing prophylaxis with respect to occurrence or recurrence of a disease in an individual. An individual may be predisposed to, susceptible to a disorder, or at risk of developing a disorder, but has not yet been diagnosed with the disorder. In some embodiments, masked cytokines described herein are used to delay development of a disorder.

As used herein, an individual "at risk" of developing a disorder may or may not have detectable disease or symptoms of disease, and may or may not have displayed detectable disease or symptoms of disease prior to the treatment methods described herein. "At risk" denotes that an individual has one or more risk factors, which are measurable parameters that correlate with development of the disease, as known in the art. An individual having one or more of these risk factors has a higher probability of developing the disorder than an individual without one or more of these risk factors.

An "effective amount" refers to at least an amount effective, at dosages and for periods of time necessary, to achieve the desired or indicated effect, including a therapeutic or prophylactic result.

An effective amount can be provided in one or more administrations. A "therapeutically effective amount" is at least the minimum concentration required to effect a measurable improvement of a particular disorder. A therapeutically effective amount herein may vary according to factors such as the disease state, age, sex, and weight of the patient, and the ability of the antibody to elicit a desired response in the individual. A therapeutically effective amount may also be one in which any toxic or detrimental effects of the masked cytokine are outweighed by the therapeutically beneficial effects. A "prophylactically effective amount" refers to an amount effective, at the dosages and for periods of time necessary, to achieve the desired prophylactic result. Typically, but not necessarily, since a prophylactic dose is used in subjects prior to or at the earlier stage of disease, the prophylactically effective amount can be less than the therapeutically effective amount.

"Chronic" administration refers to administration of the medicament(s) in a continuous as opposed to acute mode, so as to main the initial therapeutic effect (activity) for an extended period of time. "Intermittent" administration is treatment that is not consecutively done without interruption, but rather is cyclic in nature.

As used herein, an "individual" or a "subject" is a mammal. A "mammal" for purposes of treatment includes humans, domestic and farm animals, and zoo, sports, or pet animals, such as dogs, horses, rabbits, cattle, pigs, hamsters, gerbils, mice, ferrets, rats, cats, etc. In some embodiments, the individual or subject is human.

9. EXAMPLES

The invention will be more fully understood by reference to the following examples. They should not, however, be construed as limiting the scope of the invention. It is understood that the examples and embodiments described herein are for illustrative purposes only and that various modifications or changes in light thereof will be suggested to persons skilled in the art and are to be included within the spirit and purview of this application and scope of the appended claims.

Although some examples describe the engineering, production, and/or testing of "masked" versions of an polypeptide construct, some examples also employ parental "non-masked" versions of the polypeptide construct, such as for comparison, or other constructs that include one or more of the components described herein that are tested as controls for comparison. Accordingly, the description of, for instance, testing done on masked polypeptide constructs does not necessarily mean that non-masked versions of the construct were not also tested.

Example 1: Engineering of Masked IL-2 Polypeptides

Masked IL-2 polypeptide constructs are generated in accordance with the teachings herein. In the subsequent examples, some experiments involve use of the masked IL-2 polypeptide constructs in monomer form, and some experiments involve use of the masked IL-2 constructs in dimer form, such as a dimer formed through disulfide bonds linking two copies of the same masked polypeptide construct (homodimer), or a heterodimer formed by two different polypeptides (see, e.g., Table 5).

Masked IL-2 polypeptide constructs are generated that include an IL-2 polypeptide or functional fragment thereof, a masking moiety, and a half-life extension moiety, such as an antibody or fragment thereof (e.g., an Fc region, heavy chain, and/or light chain). Some IL-2 polypeptide constructs are also generated that include an IL-2 polypeptide or functional fragment thereof linked to a half-life extension moiety without also including a masking moiety. Some of the constructs also include a linker that comprises a cleavable peptide and links the masking moiety to the IL-2 polypeptide or functional fragment thereof, thereby resulting in an activatable masked IL-2 polypeptide construct. Some of the constructs also include a linker that links the IL-2 polypeptide or functional fragment thereof to the half-life extension domain. Some of the constructs also include a linker that links the IL-2 polypeptide or functional fragment thereof to the masking moiety. The masked IL-2 polypeptide constructs that do not include a cleavable peptide in the linker that links the IL-2 polypeptide or functional fragment thereof to the masking moiety are also referred to as non-activatable masked IL-2 polypeptide constructs or non-activatable IL-2 polypeptide constructs because they do not include a cleavable peptide. The structure and composition of exemplary IL-2 polypeptide constructs are provided in Table 3.

fragment thereof (e.g., an Fc region, heavy chain, and/or light chain). The masking moiety is linked to the first half-life extension moiety, the IL-2 polypeptide or functional fragment thereof is linked to the second half-life extension moiety, and the first half-life extension moiety and the second half-life extension moiety contain modifications promoting the association of the first and the second half-life extension moiety. In one exemplary embodiment, the masking moiety is linked to the first half-life extension moiety and includes the amino acid sequence of SEQ ID NO: 38, and the IL-2 polypeptide or functional fragment thereof is linked to the second half-life extension moiety and includes the amino acid sequence of SEQ ID NO: 48, and the first half-life extension moiety and the second half-life extension moiety contain modifications promoting the association of

TABLE 3

| Construct # | Cytokine or functional fragment thereof (C) | Linker (L1) | Masking moiety (MM) | Linker (L2) | Half-life extension domain (H) | Structure (N- to C-terminal direction) | Amino Acid Sequence |
|---|---|---|---|---|---|---|---|
| AK032 | SEQ ID NO: 62 | — | — | — | SEQ ID NO: 65 | H-C | SEQ ID NO: 67 |
| AK035 | SEQ ID NO: 3 | — | — | — | SEQ ID NO: 65 | H-C | SEQ ID NO: 68 |

Also generated are masked IL-2 polypeptide constructs that include an IL-2 polypeptide or functional fragment thereof, a first masking moiety, a second masking moiety, and a half-life extension moiety, such as albumin, an antibody or fragment thereof (e.g., an Fc region, heavy chain, and/or light chain), an albumin-binding peptide, an IgG-binding peptide, or a polyamino acid sequence. Some of the constructs also include a linker that links the first masking moiety to the IL-2 polypeptide or functional fragment thereof. Some of the constructs also include a linker that links the second masking moiety to the IL-2 polypeptide or functional fragment thereof. Some of the constructs include a cleavable peptide in the linker linking the first masking moiety to the IL-2 polypeptide or functional fragment thereof and/or the linker linking the second masking moiety to the IL-2 polypeptide or functional fragment thereof, thereby resulting in an activatable masked IL-2 polypeptide construct. Some of the constructs also include a linker linking the second masking moiety to the half-life extension moiety. The masked IL-2 polypeptide constructs that do not include a cleavable peptide in either of the linkers that link the IL-2 polypeptide or functional fragment thereof to the first masking moiety or the second masking moiety are also referred to as non-activatable masked IL-2 polypeptide constructs or non-activatable IL-2 polypeptide constructs because they do not include a cleavable peptide. The structure and composition of exemplary IL-2 polypeptide constructs are provided in Table 4.

the first and the second half-life extension moiety. In one exemplary embodiment of a non-masked IL-2 polypeptide construct, the embodiment comprises an IL-2 polypeptide or functional fragment thereof linked to a first half-life extension moiety, and comprises a second half-life extension moiety, where the IL-2 polypeptide or functional fragment thereof is linked to the first half-life extension moiety and includes the amino acid sequence of SEQ ID NO: 48, and the second half-life extension moiety includes the amino acid sequence of SEQ ID NO: 79. Some of the constructs also include a linker that links the masking moiety to the first half-life extension moiety, and/or a linker that links the IL-2 polypeptide or functional fragment thereof to the second half-life extension moiety. The first and second half-life extension moiety of some of the constructs are also linked. In some constructs, the first and second half-life extension moiety of some of the constructs are linked by a linker. Some of the constructs include a cleavable peptide in the linker linking the masking moiety to the first half-life extension moiety and/or the linker linking the IL-2 polypeptide or functional fragment thereof to the second half-life extension moiety, thereby resulting in an activatable masked IL-2 polypeptide construct. The masked IL-2 polypeptide constructs that do not include a cleavable peptide in either the linker that links the IL-2 polypeptide or functional fragment thereof to the second half-life extension moiety or the linker that links the masking moiety to the first half-life extension moiety are also referred to as non-activatable masked IL-2

| Construct # | Masking moiety (MM1) | Linker (L1) | Cytokine or functional fragment thereof (C) | Linker (L2) | Masking moiety (MM2) | Linker (L3) | Half-life extension moiety (H) | Structure (N- to C- terminal direction) | Amino Acid Sequence |
|---|---|---|---|---|---|---|---|---|---|
| AK041 | SEQ ID NO: 60 | SEQ ID NO: 61 | SEQ ID NO: 62 | SEQ ID NO: 63 | SEQ ID NO: 64 | SEQ ID NO: 17 | SEQ ID NO: 65 | H-LI-MM1-L2-C-L3-MM2 | SEQ ID NO: 66 |

Also generated are masked IL-2 polypeptide constructs that include an IL-2 polypeptide or functional fragment thereof, a masking moiety, a first half-life extension moiety, and a second half-life extension moiety, an antibody or polypeptide constructs or non-activatable IL-2 polypeptide constructs because they do not include a cleavable peptide. The structure and composition of exemplary IL-2 polypeptide constructs are provided in Table 5.

| Construct # | Cytokine or functional fragment thereof (C) | Linker (L1) | Masking moiety (MM) | Linker (L2) | Half-life extension moiety (H) | Structure (N - to C-terminal direction) | Amino Acid Sequence |
|---|---|---|---|---|---|---|---|
| AK081 | SEQ ID NO; 62 | SEQ ID NO: 18 | — | — | SEQ ID NO: 12 | H-L1-C | SEQ ID NO: 85 |
| | — | — | — | — | SEQ ID NO: 79 | H | SEQ ID NO: 79 |
| AK109 | — | SEQ ID NO: 17 | SEQ ID NO: 4 | — | SEQ ID NO: 80 | H-LI-MM | SEQ ID NO: 86 |
| | SEQ ID NO: 62 | — | — | — | SEQ ID NO: 81 | H-C | SEQ ID NO: 87 |
| AK110 | — | SEQ ID NO: 17 | SEQ ID NO: 4 | — | SEQ ID NO: 82 | H-LI-MM | SEQ ID NO: 88 |
| | SEQ ID NO: 62 | — | — | — | SEQ ID NO: 83 | H-C | SEQ ID NO: 89 |
| AK111 | SEQ ID NO: 62 | SEQ ID NO: 18 | — | — | SEQ ID NO: 12 | H-L1-C | SEQ ID NO: 85 |
| | — | SEQ ID NO: 14 | SEQ ID NO: 4 | — | SEQ ID NO: 9 | H-L1-MM | SEQ ID NO: 38 |
| AK165 | SEQ ID NO: 62 | SEQ ID NO: 18 | — | — | SEQ ID NO: 83 | H-L1-C | SEQ ID NO: 90 |
| | — | — | — | — | SEQ ID NO: 84 | H | SEQ ID NO: 91 |
| AK166 | SEQ ID NO: 62 | SEQ ID NO: 18 | — | — | SEQ ID NO: 83 | H-L1-C | SEQ ID NO: 90 |
| | — | SEQ ID NO: 75 | SEQ ID NO: 4 | — | SEQ IDNO:82 | H-L1-MM | SEQ ID NO: 92 |
| AK167 | SEQ ID NO: 3 | SEQ ID NO: 18 | — | — | SEQ ID NO: 12 | H-L1-C | SEQ ID NO: 45 |
| | — | — | — | — | SEQ ID NO: 79 | H | SEQ ID NO: 79 |
| AK168 | SEQ ID NO: 3 | SEQ ID NO: 18 | — | — | SEQ ID NO: 12 | H-L1-C | SEQ ID NO: 45 |
| | — | SEQ ID NO: 14 | SEQ ID NO: 4 | — | SEQ ID NO; 9 | H-L1-MM | SEQ ID NO: 38 |
| AK189 | SEQ ID NO: 62 | SEQ ID NO: 76 | — | — | SEQ ID NO: 12 | H-L1-C | SEQ ID NO: 93 |
| | — | SEQ ID NO: 14 | SEQ ID NO: 4 | — | SEQ ID NO: 9 | H-L1-MM | SEQ ID NO: 38 |
| AK190 | SEQ ID NO: 62 | SEQ ID NO: 77 | — | — | SEQ ID NO: 12 | H-L1-C | SEQ ID NO: 94 |
| | — | SEQ ID NO: 14 | SEQ ID NO: 4 | — | SEQ ID NO: 9 | H-L1-MM | SEQ ID NO: 38 |
| AK191 | SEQ ID NO: 3 | SEQ ID NO: 20 | — | — | SEQ ID NO: 12 | H-L1-C | SEQ ID NO: 46 |
| | — | SEQ ID NO: 14 | SEQ ID NO: 4 | — | SEQ ID NO: 9 | H-L1-MM | SEQ ID NO: 38 |
| AK192 | SEQ ID NO: 3 | SEQ ID NO: 76 | — | — | SEQ ID NO: 12 | H-L1-C | SEQ ID NO: 95 |
| | — | SEQ ID NO: 14 | SEQ ID NO: 4 | — | SEQ ID NO; 9 | H-L1-MM | SEQ ID NO: 38 |
| AK193 | SEQ ID NO: 3 | SEQ ID NO: 77 | — | — | SEQ ID NO: 12 | H-L1-C | SEQ ID NO: 96 |
| | — | SEQ ID NO: 14 | SEQ ID NO: 4 | — | SEQ ID NO: 9 | H-L1-MM | SEQ ID NO: 38 |
| AK197 | SEQ ID NO: 3 | SEQ ID NO: 21 | — | — | SEQ ID NO: 12 | H-L1-C | SEQ ID NO: 47 |
| | — | SEQ ID NO: 14 | SEQ ID NO: 4 | — | SEQ ID NO: 9 | H-L1-MM | SEQ ID NO; 38 |
| AK203 | SEQ ID NO: 3 | SEQ ID NO: 22 | — | — | SEQ ID NO: 12 | H-L1-C | SEQ ID NO: 48 |
| | — | SEQ ID NO: 14 | SEQ ID NO: 4 | — | SEQ ID NO:9 | H-L1-MM | SEQ ID NO: 38 |
| AK209 | SEQ ID NO: 3 | SEQ ID NO: 78 | — | — | SEQ ID NO: 12 | H-L1-C | SEQ ID NO: 49 |
| | — | SEQ ID NO: 14 | SEQ ID NO: 4 | — | SEQ ID NO; 9 | H-L1-MM | SEQ ID NO: 38 |
| AK210 | SEQ ID NO: 62 | SEQ ID NO: 20 | — | — | SEQ ID NO; 12 | H-L1-C | SEQ ID NO: 97 |
| | — | SEQ ID NO: 14 | SEQ ID NO: 4 | — | SEQ ID NO: 9 | H-L1-MM | SEQ ID NO: 38 |
| AK211 | SEQ ID NO: 3 | SI Q ID NO: 23 | — | — | SEQ ID NO: 12 | H-L1-C | SEQ ID NO: 98 |
| | — | SEQ ID NO: 14 | SEQ ID NO: 4 | — | SEQ ID NO: 9 | H-L1-MM | SEQ ID NO: 38 |
| AK215 | SEQ ID NO: 69 | SEQ ID NO: 18 | — | — | SEQ ID NO: 12 | H-L1-C | SEQ ID NO: 99 |
| | — | SEQ ID NO: 14 | SEQ ID NO: 4 | — | SEQ ID NO: 9 | H-L1-MM | SEQ ID NO: 38 |
| AK216 | SEQ ID NO: 70 | SEQ ID NO: 18 | — | — | SEQ ID NO: 12 | H-L1-C | SEQ ID NO: 100 |
| | — | SEQ ID NO: 14 | SEQ ID NO: 4 | — | SEQ ID NO: 9 | H-L1-MM | SEQ ID NO: 38 |
| AK218 | SEQ ID NO: 71 | SEQ ID NO: 18 | — | — | SEQ ID NO: 12 | H-L1-C | SEQ ID NO: 101 |
| | — | SEQ ID NO: 14 | SEQ ID NO: 4 | — | SEQ ID NO: 9 | H-L1-MM | SEQ ID NO: 38 |
| AK219 | SEQ ID NO: 72 | SEQ ID NO: 18 - | — | — | SEQ ID NO: 12 | H-L1-C | SEQ ID NO: 102 |
| | — | SEQ ID NO: 14 | SEQ ID NO: 4 | — | SEQ ID NO: 9 | H-L1-MM | SEQ ID NO: 38 |
| AK220 | SEQ ID NO: 873 | SEQ ID NO: 18 | — | — | SEQ ID NO: 12 | H-L1-C | SEQ ID NO: 103 |
| | — | SEQ ID NO: 14 | SEQ ID NO: 4 | — | SEQ ID NO: 9 | H-L1-MM | SEQ ID NO: 38 |
| AK223 | SEQ ID NO: 74 | SEQ ID NO: 18 | — | — | SEQ ID NO: 12 | H-L1-C | SEQ ID NO: 104 |
| | — | SEQ ID NO: 14 | SEQ ID NO: 4 | — | SEQ ID NO: 9 | H-L1-MM | SEQ ID NO: 38 |
| AK235 | SEQ ID NO: 3 | SEQ ID NO: 78 | — | — | SEQ ID NO: 12 | H-L1-C | SEQ ID NO: 49 |
| | — | — | — | — | SEQ ID NO: 79 | H | SEQ ID NO: 79 |
| AK253 | SEQ ID NO: 3 | SEQ ID NO: 23 | — | — | SEQ ID NO: 12 | H-L1-C | SEQ ID NO: 98 |
| | — | — | — | — | SEQ ID NO: 79 | H | SEQ ID NO: 79 |
| AK304 | SEQ ID NO: 69 | SEQ ID NO: 78 | — | — | SEQ ID NO: 12 | H-L1-C | SEQ ID NO: 105 |
| | — | — | — | — | SEQ ID NO: 9 | H | SEQ ID NO: 70 |
| AK305 | SEQ ID NO: 69 | SEQ ID NO: 78 | — | — | SEQ ID NO: 12 | H-L1-C | SEQ ID NO: 105 |
| | — | SEQ ID NO: 14 | SEQ ID NO: 4 | — | SEQ ID NO: 9 | H-L1-MM | SEQ ID NO: 38 |
| AK306 | SEQ ID NO: 70 | SEQ ID NO: 78 | — | — | SEQ ID NO: 12 | H-L1-C | SEQ ID NO: 106 |
| | — | — | — | — | SEQ ID NO: 79 | H | SEQ ID NO: 79 |
| AK307 | SEQ ID NO: 70 | SEQ ID NO: 78 | — | — | SEQ ID NO: 12 | H-L1-C | SEQ ID NO: 106 |
| | — | SEQ ID NO: 14 | SEQ ID NO:4 | — | SEQ ID NO: 9 | H-L1-MM | SEQ ID NO: 38 |
| AK308 | SEQ ID NO: 71 | SEQ ID NO: 78 | — | — | SEQ ID NO: 12 | H-L1-C | SEQ ID NO: 107 |
| | — | — | — | — | SEQ ID NO: 79 | H | SEQ ID NO: 79 |
| AK309 | SEQ ID NO: 71 | SEQ ID NO: 78 | — | — | SEQ ID NO: 12 | H-L1-C | SEQ ID NO: 107 |
| | — | SEQ ID NO: 14 | SEQ ID NO: 4 | — | SEQ ID NO: 9 | H-L1-MM | SEQ ID NO: 38 |
| AK 310 | SEQ ID NO: 72 | SEQ ID NO: 78 | — | — | SEQ ID NO: 12 | H-L1-C | SEQ ID NO: 108 |
| | — | — | — | — | SEQ ID NO: 79 | H | SEQ ID NO: 79 |
| AK 311 | SEQ ID NO: 72 | SEQ ID NO: 78 | — | — | SEQ ID NO: 12 | H-L1-C | SEQ ID NO: 108 |
| | — | SEQ ID NO: 14 | SEQ ID NO:4 | — | SEQ ID NO: 9 | H-L1-MM | SEQ ID NO: 38 |
| AK 312 | SEQ ID NO: 73 | SEQ ID NO: 78 | — | — | — | H-L1-C | SEQ ID NO: 109 |
| | — | — | — | — | — | H | SEQ ID NO: 79 |
| AK 313 | SEQ ID NO: 73 | SEQ ID NO: 78 | — | — | SEQ ID NO: 13 | H-L1-C | SEQ ID NO: 109 |
| | — | SEQ ID NO: 14 | SEQ ID NO: 4 | — | SEQ ID NO: 9 | H-L1-MM | SEQ ID NO: 38 |
| AK 314 | SEQ ID NO: 74 | SEQ ID NO: 78 | — | — | SEQ ID NG: 12 | H-L1-C | SEQ ID NO: 110 |
| | — | — | — | — | SEQ ID NO: 9 | H | SEQ ID NO: 79 |
| AK 315 | SEQ ID NO: 74 | SEQ ID NO: 78 | — | — | SEQ ID NO: 12 | H-L1-C | SEQ ID NO: 110 |
| | — | SEQ ID NO: 14 | SEQ ID NO: 4 | — | SEQ ID NO: 9 | H-L1-MM | SEQ ID NO: 38 |

| Construct # | Cytokine or functional fragment thereof (C) | Linker (L1) | Masking moiety (MM) | Linker (L2) | Half-life extension moiety (H) | Structure (N - to C-terminal direction) | Amino Acid Sequence |
|---|---|---|---|---|---|---|---|
| AK 316 | SEQ ID NO: 62 — | SEQ ID NO: 78 — SEQ ID NO: 14 | — SEQ ID NO: 4 | — — | SEQ ID NO: 12 SEQ ID NO: 9 | H-L1-C H-L1-MM | SEQ ID NO: 112 SEQ ID NO: 38 |

Example 2: In Vitro Characterization of Masked IL-2 Polypeptides

The masked IL-2 polypeptide constructs generated in Example 1 are characterized using several cellular and functional assays in vitro.

Production

Plasmids encoding the constructs (e.g., masked IL-2 polypeptide constructs) were transfected into either Expi293 cells (Life Technologies A14527) or HEK293-6E cells (National Research Council; NRC). Transfections were performed using 1 mg of total DNA using PEIpro (Polyplus Transfection, 115-100) in a 1:1 ratio with the total DNA. The DNA and PEI were each added to 50 mL of OptiMem (Life Technologies 31985088) medium and sterile filtered. The DNA and PEI were combined for 10 minutes and added to the Expi293 cells with a cell density of $1.8$-$2.8 \times 10^6$ cells/mL or $0.85$-$1.20 \times 10^6$ cells/m, for expi293 cells or HEK293 cells, respectively, and a viability of at least 95%. The HEK293-6E transfection was performed with a cell density of and a viability of at least 95%, following the same protocol used for the Expi293 transfections. After 5-7 days, the cells were pelleted by centrifugation at 3000×g and the supernatant was filtered through a 0.2 μm membrane. Protein A resin (CaptivA, Repligen CA-PRI-0005) was added to the filtered supernatant and incubated for at least 2 hours at 4° C. with shaking. The resin was packed into a column, washed with 15 column volumes of 20 mM citrate, pH 6.5, and then washed with 15 column volumes of 20 mM citrate, 500 mM sodium chloride, pH 6.5. The bound protein was eluted from the column with 20 mM citrate, 100 mM NaCl, pH 2.9.

The titer (mg/L) of exemplary constructs produced, including parental (e.g., non-masked) and masked constructs, is provided in Table 6, below.

TABLE 6

| Construct ID | Titer (mg/L) |
|---|---|
| AK032 | 5.8 |
| AK035 | 16.7 |
| AK081 | 23.5 |
| AK111 | 12.7 |
| AK165 | 13.5 |
| AK166 | 17.1 |
| AK167 | 56.4 |
| AK168 | 36.1 |
| AK203 | 83.2 |
| AK209 | 27.3 |
| AK211 | 43.8 |
| AK235 | 35.9 |
| AK253 | 41.4 |
| AK304 | 19.9 |
| AK305 | 53.2 |
| AK306 | 29.3 |
| AK307 | 62.9 |
| AK314 | 60 |
| AK315 | 59.8 |
| AK316 | 69.2 |
| AK308 | 74.5 |

TABLE 6-continued

| Construct ID | Titer (mg/L) |
|---|---|
| AK309 | 90.8 |
| AK310 | 44 |
| AK311 | 64.9 |
| AK312 | 154 |
| AK313 | 81.2 |

SDS-PAGE Analysis

For SDS-PAGE analysis, protein samples were made with 4× Laemmli sample buffer (BioRad Catalog Number 1610747). For the reduced samples, 0.1 M Bond Breaker TCEP Solution (Thermo Scientific 77720) was added and the samples were heated for 5 minutes at 65° C. The proteins were loaded into a 12-well NuPage 4-12% Bis-Tris Protein Gel (Invitrogen NP0322BOX), with 4 μg of protein loaded per well.

The gel was stained using SimplyBlue SafeStain (Invitrogen LC6065).

Figure 4:
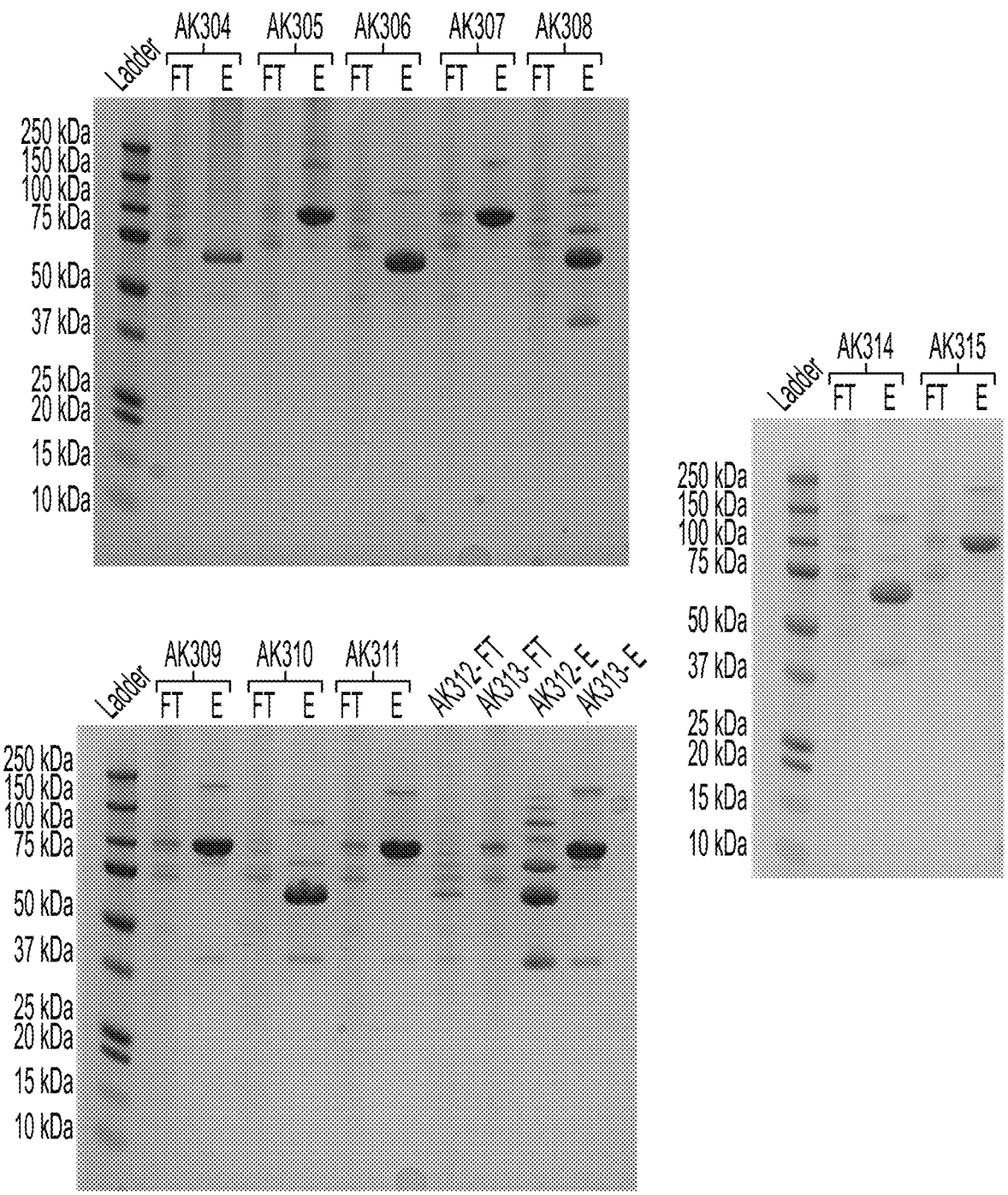
FIG. 4 shows SDS-PAGE analysis on flow-through (FT) samples (i.e., proteins that did not bind to the Protein A column) and the eluted I samples (i.e., proteins that bound to the Protein A column and were eluted from it) following production and purification of IL-2 constructs (AK304, AK305, AK307, AK308, AK309, AK310, AK311, AK312, AK313, AK314, and AK315).

As depicted in FIG. 4, SDS-PAGE analysis was performed on the flow-through (FT) samples (i.e., proteins that did not bind to the Protein A column) and the eluted (E) samples (i.e., proteins that bound to the Protein A column and were eluted from it) following production and purification of exemplary constructs (AK304, AK305, AK307, AK308, AK309, AK310, AK311, AK312, AK313, AK314, and AK315). This exemplary data demonstrates that constructs as described herein can be successfully produced and purified.

Reporter Bioassays

Reporter bioassays are performed on masked IL-2 polypeptide constructs, along with non-masked parental constructs or other controls, to monitor activation of a downstream pathway, such as the JAK-STAT pathway.

In some studies, HEK-Blue IL-2 reporter cells (Invivogen) were used to test activation of the JAK-STAT pathway in accordance with the following method. HEK-Blue IL-2 cells passage 6 (p6) (97% live) were washed 2× with assay medium (DMEM+10% heat-inactivated FBS), plated in 3 plated at 5e4 cells/well in 150 uL of assay medium, and rested in assay medium for about 2 hours to allow adherence to plate. Each construct tested was diluted to 300 pM in assay medium, then diluted 1:2 down the plate. 50 μL of each dilution was added, for a final starting concentration of 75 pM. HEK-Blue IL-2 cell supernatant was harvested after 24 hours, an incubated with Quantiblue (180 uL+20 uL supernatant), plus 3 wells/plate of assay medium, at 37 deg C. for 1 hour. The absorbance was read using a Biotek Neo2 at 625 nm. In some studies, CTLL2 cells were used to test activation of the JAK-STAT pathway in accordance with the following method. CTLL2 cells were plated at 40,000 cell per well in RPMI with 10% FBS. Dilutions of the constructs of interest were added and incubated at 37 degrees. After 6 hours, the Bio-Glo reagent was added and luminescence measured with a BioTek Synergy Neo2 plate reader.

Receptor Binding

The binding of the masked IL-2 polypeptide constructs generated in Example 1 is assessed. ELISA plates are coated with a receptor subunit, such as IL-2Rα (also referred to as CD25), IL-2Rβ (also referred to as CD122), or IL-2Rγ (also referred to as CD132), or combinations thereof. Dilutions of masked IL-2 polypeptide constructs are allowed to bind to the receptor subunit(s) and are detected using an anti-huFc-HRP detection antibody. The binding of the masked IL-2 polypeptide constructs is determined in conditions with and without protease cleavage.

On-Cell Receptor Binding

The on-cell receptor binding of the masked IL-2 polypeptide constructs generated in Example 1 is assessed. Dilutions of masked IL-2 polypeptide constructs are allowed to bind to peripheral blood lymphocytes or tissue culture cells, such as CTLL2 cells and are detected by fluorescence activated cell sorting (FACS) using an anti-huFc-FITC or anti-albumin-FITC detection antibody. The binding of the masked IL-2 polypeptide constructs is determined in conditions with and without protease cleavage.

Receptor Binding Affinity

The binding affinity of the masked IL-2 polypeptide constructs generated in Example 1 is assessed. The binding affinity of the masked IL-2 polypeptide constructs is determined in conditions with and without protease cleavage.

For SPR studies testing binding of masked and non-masked IL-2 polypeptide constructs, Reichert Carboxymethyl Dextran Hydrogel Surface Sensor Chips were coated and immobilized with the construct of interest (e.g., a masked IL-2 polypeptide construct or non-masked IL-2 polypeptide construct) at 30 ug/ml in 10 mM Sodium Acetate, pH 5.0 via amine coupling with EDC and NHS. Dilutions of CD25-Fc or Fc-CD122 in PBST (CD25: 16 nM, 8 nM, 4 nM, 2 nM, 1 nM and CD122: 500 nM, 250 nM, 125 nM, 62.5 nM, 31.25 nM) were prepared. Using a Reichert 4Channel SPR, dilutions of CD25 or CD122 were flowed over the clips with the immobilized construct to determine the on rate at 25 degrees C. At equilibrium (approximately 3 minutes), the flow buffer was changed to PBST, to determine the off rates over 6 minutes. Between each run the chip was regenerated with 10 mM glycine, pH 2.0.

FIGS. 5A-5D depicts the efficacy of mutations on IL-2 which prevent binding to its alpha-receptor, using SPR analysis that tested the binding of an exemplary masked IL-2 polypeptide construct (AK168) to CD25-Fc. FIG. 5A depicts the interaction between AK168 and CD25-Fc, FIG. 5B depicts the interaction between AK168 activated with MMP and CD25-Fc, and FIG. 5C depicts the interaction between a recombinant human IL-2 (rhIL-2) control and CD25-Fc. FIG. 5D provides a table summarizing the data obtained for the association constant (ka), dissociation constant (kd), equilibrium dissociation constant (KD), as well as the Chi$^2$ value and U-value for each interaction. These results demonstrate that this exemplary masked IL-2 polypeptide construct (AK168) did not demonstrate detectable binding to CD25-Fc, while the wild-type rhIL-2 control did demonstrate detectable binding.

FIGS. 6A-6D depicts the masking of IL-2 towards its beta-receptor as well as restoration of binding post activation with protease, using SPR analysis that tested the binding of an exemplary masked IL-2 polypeptide construct (AK211) to CD122-Fc. FIG. 6A depicts the interaction between Ahu11 and CD122-Fc, FIG. 6B depicts the interaction between AK11 activated with MMP and CD122-Fc, and FIG. 6C depicts the interaction between a recombinant human IL-2 (rhIL-2) control and CD122-Fc. FIG. 6D provides a table summarizing the data obtained for the association constant (ka), dissociation constant (kd), equilibrium dissociation constant (KD), as well as the Chi$^2$ value and U-value for each interaction. These results demonstrate that this exemplary masked IL-2 polypeptide construct (AK111) did not demonstrate detectable binding to CD122-Fc unless it has been activated with protease, while the rhIL-2 control did demonstrate detectable binding. Additional exemplary SPR data is provided below in Table 7 for various constructs tested, including masked and non-masked constructs. For some structures, when applicable, the KD was determined for the construct with or without having been previously cleaved by a protease.

TABLE 7

| Construct | KD for CD25 (without protease cleavage) | KD for CD122 (without protease cleavage) | KD for CD122 (after protease cleavage) |
|---|---|---|---|
| rhIL2 | 0.878 nM | 124 nM | N/A |
| AK032 | 1.76 nM | 260 nM | N/A |
| AK035 | No binding detected | 110 nM | N/A |
| AK081 | 0.875 nM | 347 nM | N/A |
| AK109 | 167 nM | No binding detected | 118 nM |
| AK110 | 0.911 nM | No binding detected | 195 nM |
| AK111 | 0.4 nM | No binding detected | 235 nM |
| AK168 | No binding detected | Not determined | 175 nM |
| AK215 | No binding detected | | |
| AK216 | No binding detected | | |
| AK218 | Weak binding | | |
| AK219 | Weak binding | | |
| AK220 | Weak or no binding detected | | |
| AK223 | No binding detected | | |

Cleavage

The cleavage rate of the masked IL-2 polypeptide constructs is assessed by conducting receptor-binding assays, as described above, after incubation of the masked IL-2 peptide constructs in the presence or absence of a protease, and with the protease, if any, inactivated at various time points, such as by the addition of EDTA. The cleavage rate is also assessed using reducing and non-reducing polyacrylamide gel electrophoresis (PAGE) and by mass spectrometry whole mass and peptide map analyses. The cleavage rate is also assessed using an ex vivo assay in which the masked IL-2 polypeptide constructs are exposed to human, mouse, or cynomolgus monkey peripheral blood lymphocytes, or normal human tissue or human tumor tissue.

For some protease activation studies, MMP10 was diluted to 50 ng/uL in MMP cleavage buffer and activated with 1 mM APMA for 2 h at 37° C. 5 µL of protease (250 ng total) of the activated protease was incubated with 1 uM of masked cytokine constructs and incubated at 37 degrees for 2 hours. Cleavage was assessed by SDS-PAGE using AnykD™ Criterion™ TGX Stain-Free™ Protein Gels. A similar approach is taken to test cleavage by other proteases.

Figure 7B:
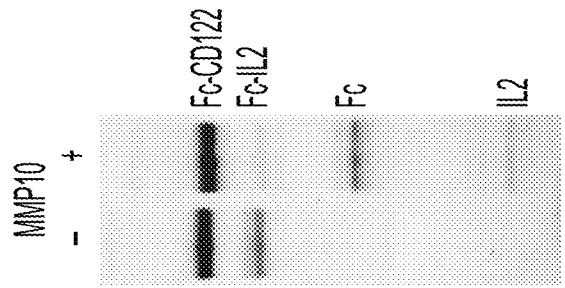
FIG. 7B shows SDS-PAGE analysis of an exemplary masked IL-2 polypeptide construct that was incubated in the absence (left lane) or presence (right lane) of the MMP10 protease, which demonstrates the release of IL-2 from the Fc portion.
Figure 7A:
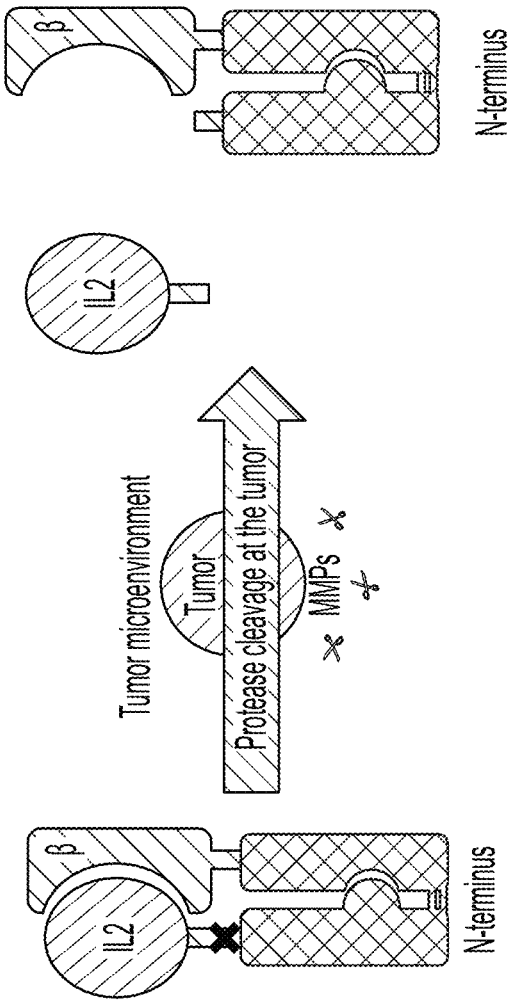
FIG. 7A shows an exemplary embodiment of a masked cytokines prior to (left) and after (right) cleavage by a protease, such as at the tumor microenvironment.
Figure 8A:
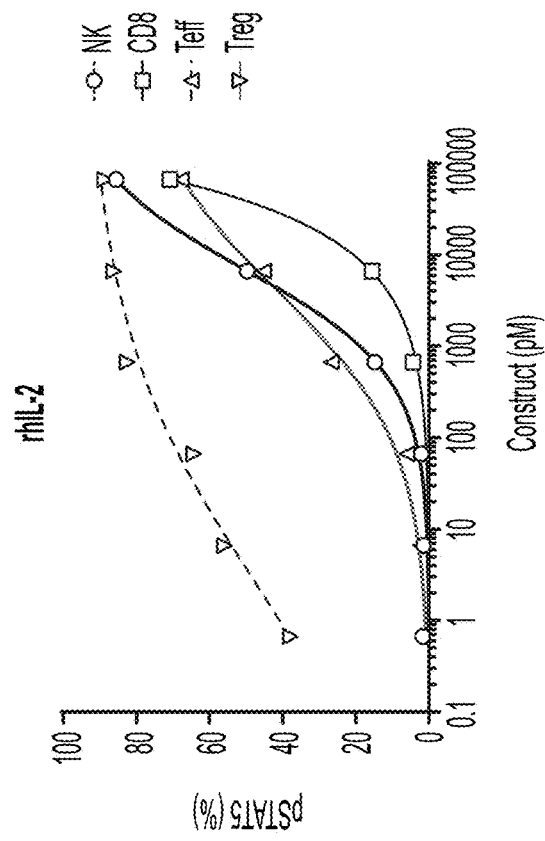
FIGS. 8A-D show STAT5 activation (%) in PBMCs treated with the construct AK032, AK035, AK041, or rhIL-2 as a control. The levels of STAT5 activation (%) are shown for NK cells, CD8+ T cells, effector T cells (Teff), and regulatory T cells (Treg), as determined following incubation with rhIL-2 (FIG. 8A), AK032 (FIG. 8B), AK035 (FIG. 8C), or AK041 (FIG. 8D).
Figure 8B:
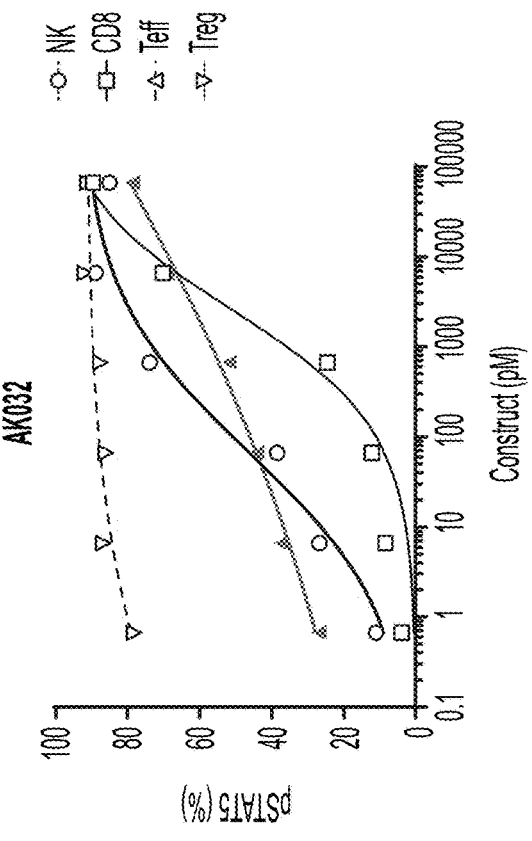
Figure 8C:
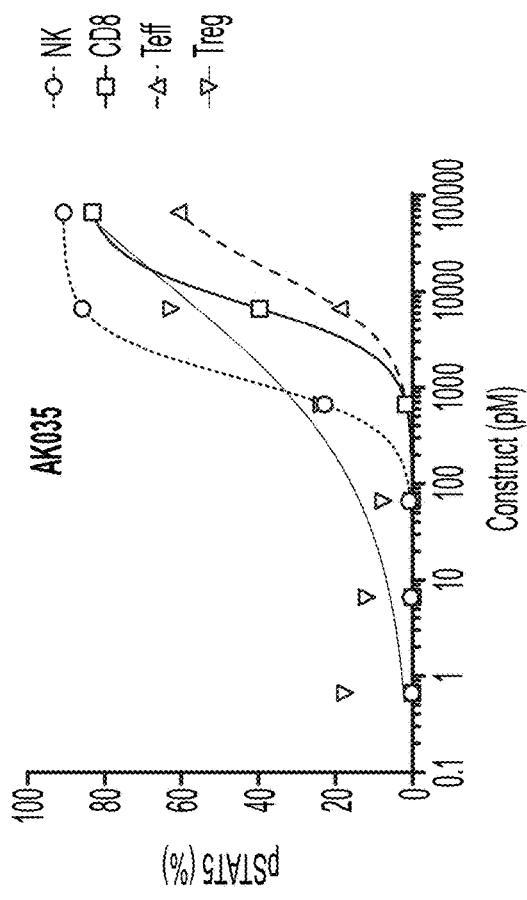
Figure 8D:
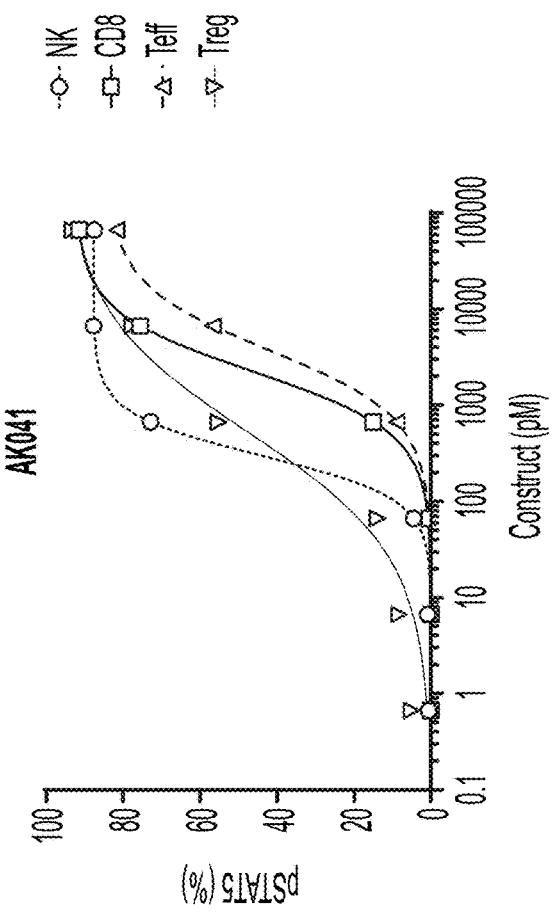

FIG. 7A depicts an exemplary structure of a masked IL-2 polypeptide prior to (left) and after (right) cleavage by a protease, such as a protease associated with the tumor environment. FIG. 7B depicts SDS-PAGE analysis of an exemplary masked IL-2 polypeptide construct that was incubated in the absence (left lane) or presence (right lane) of the MMP10 protease.

Proliferation

Proliferation of IL-2 responsive tissue culture cell lines, such as CTLL2, YT, TF1B, LGL, HH, and CT6, following treatment with the masked IL-2 polypeptide constructs generated in Example 1 is assessed. For experiments involving the masked IL-2 polypeptide constructs, cells are plated in 96 well tissue culture plates in media lacking IL-2 for 2-4 hours and then treated with the masked IL-2 polypeptide constructs at various concentrations. After incubation at 37 degrees for 24-48 hours, the cell number is determined by the addition of MTS, alamar blue, luciferase, or a similar metabolic detection reagent, and the colorimetric, fluorescent or luciferase readout detected by a plate spectrophotometer reader.

The proliferation of immune cells following treatment with the masked IL-2 polypeptide constructs generated in Example 1 is also assessed. Human, mouse, or cynomolgus peripheral blood mononuclear cells (PBMCs) are treated with the constructs at various concentrations, and the proliferation of cell types, such as Natural Killer (NK) cells, CD8+ T cells, CD4+ T cells, and/or Treg cells, is determined by staining for the particular cell type and analysis via fluorescence activated cell sorting (FACS). In some experiments, some PBMCs are treated with controls for comparison. In some experiments, some PBMCs are treated with aldesleukin as a control for the masked IL-2 polypeptide treatment. In some experiments, the NK cells are stained as CD45+CD3−CD56+, the CD8+ T cells are stained as CD45+CD3+CD8+, the CD4+ T cells are stained as CD45+CD3+CD4+CD25−, and the Treg cells are stained as CD45+CD3+CD4+CD25+FOXP3+. In some experiments, the PBMCs are treated for a period of five days. In some experiments, the PBMCs are also stained with Ki67, a marker of cell proliferation. In some experiments, the PBMCs are labeled with CFSE (Sigma-Aldrich) prior to treatment and proliferation is measured by determining the extent of CFSE dilution. In some experiments, each construct, as well as aldesleukin and/or other controls, is administered at one or more concentrations, such as one or more concentrations ranging from 0.0001 nM to 500 nM.

STAT5 Activation

The activation of Signal Transducer and Activator of Transcription 5 (STAT5) following treatment with the masked IL-2 polypeptide constructs generated in Example 1 is also assessed. PBMCs are treated with the constructs for a specified period of time and are then immediately fixed to preserve the phosphorylation status of proteins, such as STAT5. In some experiments, some PBMCs are treated with controls for comparison. In some experiments, some PBMCs are treated with aldesleukin as a control for the masked IL-2 polypeptide treatment. In some experiments, the masked IL-2 polypeptide constructs are tested in conditions with and without protease cleavage (e.g., activation). In some experiments, the PBMCs are treated for 10 minutes, 15 minutes, 20 minutes, or 25 minutes. In some experiments, each construct, as well as aldesleukin and/or other controls, is administered at one or more concentrations, such as one or more concentrations ranging from 0.0001 nM to 500 nM. In some experiments, the fixed and permeabilized PBMCs are then stained with an antibody specific for phosphorylated STAT5 (phospho-STAT5) and are analyzed by flow cytometry. In some experiments, total and phosphorylated levels of STAT5 are measured. The phospho-STAT5 status of certain cell types, such as NK cells, CD8+ T cells, CD4+ T cells, and/or Treg cells, is determined by staining for the particular cell type. In some experiments, the NK cells are stained as CD45+CD3−CD56+, the CD8+ T cells are stained as CD45+CD3+CD8+, the CD4+ T cells are stained as CD45+CD3+CD4+CD25−, and the Treg cells are stained as CD45+CD3+CD4+CD25+FOXP3+.

The activation of STAT5 in the mouse cell lines, such as CTLL-2 cells, following treatment with the masked IL-2 polypeptide constructs generated in Example 1 is also assessed. In some experiments, some CTLL-2 cells are treated with controls for comparison. In some experiments, some CTLL-2 cells are treated with aldesleukin as a control for the masked IL-2 polypeptide treatment. In some experiments, the masked IL-2 polypeptide constructs are tested in conditions with and without protease cleavage (e.g., activation). In some experiments, the CTLL-2 cells are treated for 10 minutes, 15 minutes, 20 minutes, or 25 minutes, and are then fixed to preserve the phosphorylation status of proteins, such as STAT5. In some experiments, each construct, as well as aldesleukin and/or other controls, is administered at one or more concentrations. In some experiments, total and phosphorylated levels of STAT5 are measured.

In some studies, the levels of intracellular STAT5 activation (pSTAT5 signal) induced by IL-2 was determined by the following method. Frozen human PBMCs were thawed in water bath and added to 39 mL pre-warmed media (RPMI1640 medium plus 10% FBS, 1% P/S, 1% NEA), spun and reconstitute in media at 10E6 cells/mL. Cells were plated at 5E5 per well cells in a 96 well plate. IL-2 (e.g., rhIL-2 or an exemplary IL-2-containing polypeptide construct) diluted in medium was added to each well, and incubated at 37° C. for 20 min. Cells were then fix with 200 ul/well Fixation buffer (eBiosciences) at 4° C., overnight. After centrifugation, the fixed cells were resuspended in 200 ul cold BD Phosflow buffer and incubated at 4° C. for 30 min. After washing the cells twice, they were treated with Biolegend Human TruStain FcX (2.5 uL in 50 uL total per sample in Staining buffer) for 5 min on ice. Staining antibodies were added; 5ul pSTAT5-APC (pY694, BD), 10 ul CD56-BV421 (5.1H11, Biolegend), 10 ul CD4-PerCP/Cy5.5 (A161A1, Biolegend), and 10 ul CD3-FITC (UCHT1, Biolegend) and incubated for 30 min, on ice, protected from light. Cells were washed 2 times and resuspended, and analyzed by flow cytometry.

FIGS. 8A-8D depict the results from STAT5 activation studies, as described above, using the exemplary constructs AK032, AK035, AK041, or rhIL-2 as a control. The levels of STAT5 activation (%) are shown for NK cells, CD8+ T cells, effector T cells (Teff), and regulatory T cells (Treg). The AK032 and AK035 constructs include an IL-2 polypeptide linked to an Fc domain, and the AK041 construct includes an IL-2 polypeptide linked to a CD25 domain and a CD122 domain. As shown, engineered IL-2 polypeptide constructs can, in some embodiments, reduce activation of Treg cells while retaining or enhancing activation of CD8+ T cells and NK cells.

FIGS. 9A-9C depict the results from STAT5 activation studies, as described above, using the exemplary constructs AK081 and AK032. The AK081 construct with and without prior exposure to MMP10 was tested. An isotype control as well as a no IL-2 negative control was also tested. The levels of STAT5 activation (%) are shown for NK cells, CD8+ T cells, and CD4+ T cells. The AK032 and AK081 constructs include an IL-2 polypeptide linked to an Fc domain, and the AK081 construct includes a cleavable peptide in the linker connecting the IL-2 polypeptide to the Fc domain. As shown, the non-masked monomeric AK081 IL-2 polypeptide construct stimulates STAT5 activation of PBMCs with or without protease activation similarly to the non-masked dimeric AK032 IL-2 polypeptide construct.

Figure 10A:
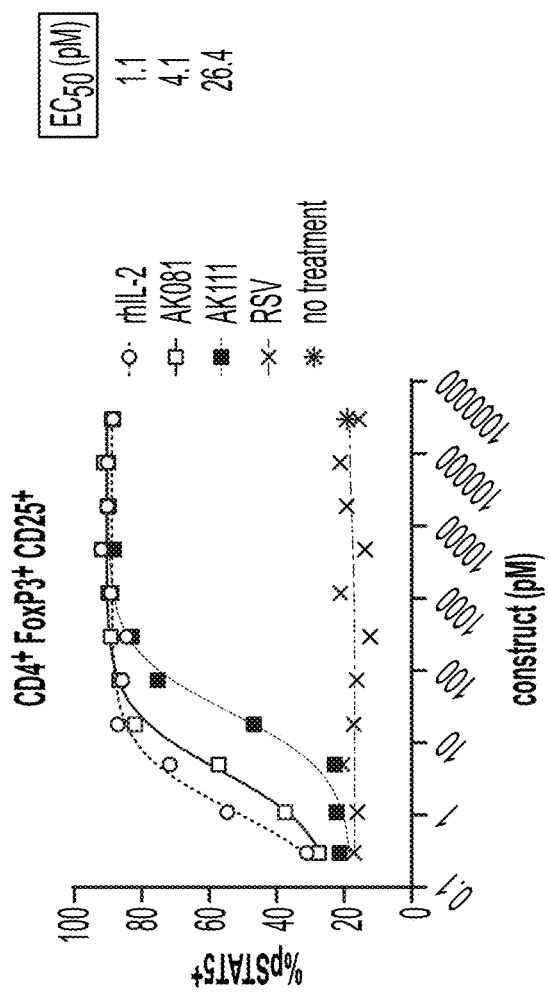
FIGS. 10A-10D show the results from STAT5 activation studies in PBMCs using constructs AK081 and AK11, as well as controls that included an rhIL-2 and anti-RSV antibody. A no-treatment control was also tested. EC50 (pM) is also shown for the rhIL-2, AK081, and AK111 treatments. STAT5 activation (%) is shown for CD4+FoxP3+CD25+ cells (FIG. 10A), CD8+ cells (FIG. 10B), and CD4+FoxP3-CD25- cells (FIG. 10C).
Figure 10B:
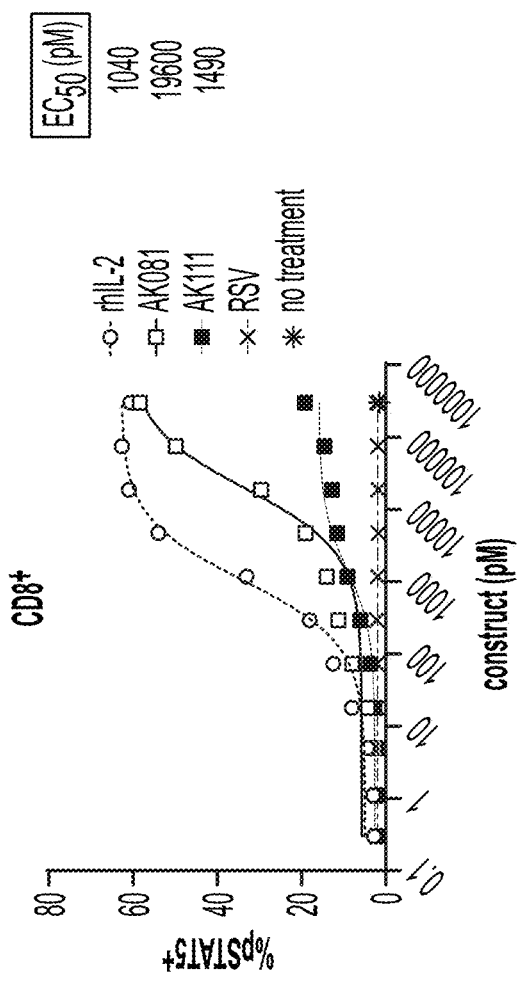
Figures 10C, 10D:
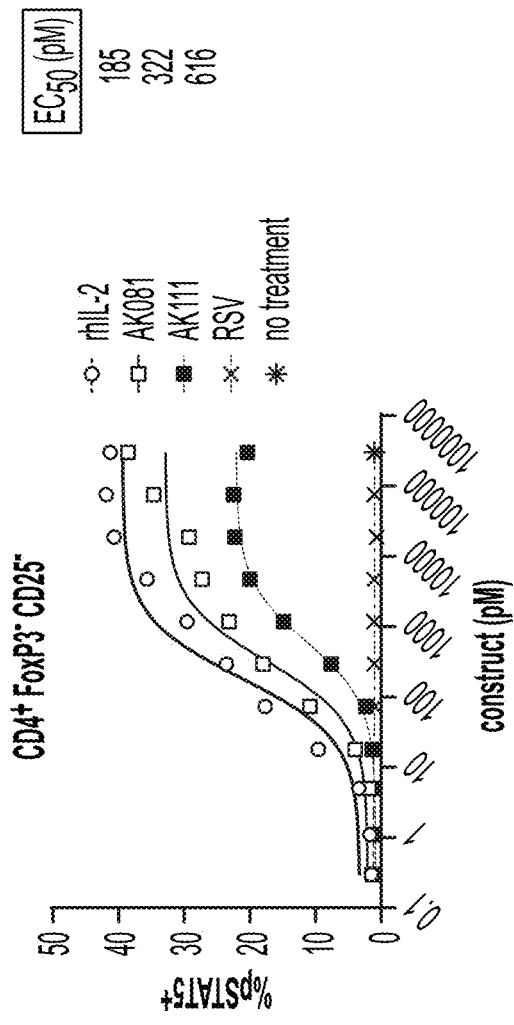

FIGS. 10A-10D depict the results from STAT5 activation studies, as described above, using the exemplary constructs AK081 and AK111, as well as controls that included an rhIL-2 and anti-RSV antibody. A no-treatment control was also tested. The AK111 construct is an exemplary masked IL-2 polypeptide construct that includes a wildtype form of an IL-2 polypeptide (except for a C125A mutation). As shown in FIGS. 10A-10D, the masked IL-2 polypeptide construct AK111 demonstrated reduced STAT5 activation as compared to the non-masked IL-2 polypeptide construct AK081. FIG. 10D provides EC50 (pM) and fold-change data for the AK081, AK111 constructs, as well as the rhIL-2 control.

Figures 11C, 11D:
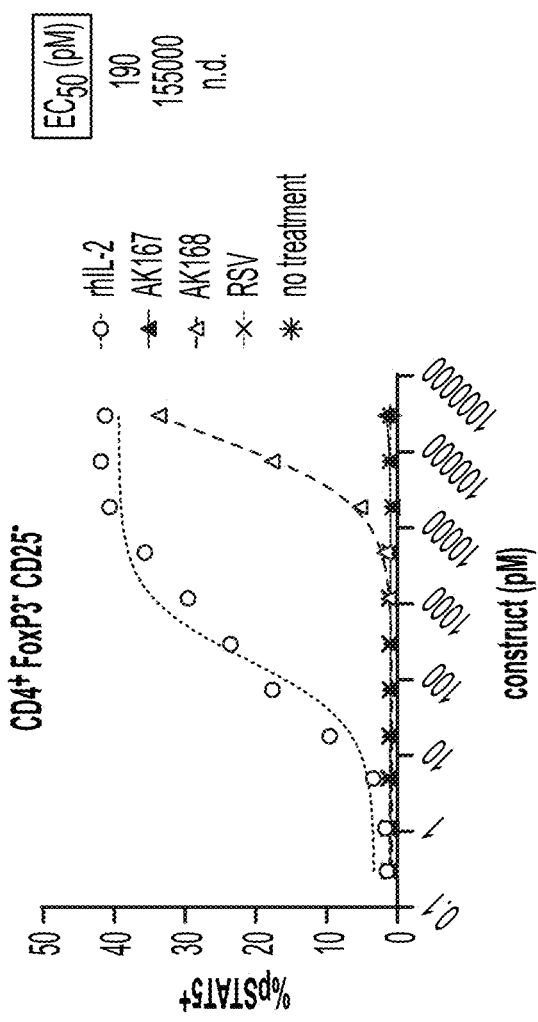

FIGS. 11A-11D depict the results from STAT5 activation studies, as described above, using the exemplary constructs AK167 and AK168, as well as controls that included an rhIL-2 and anti-RSV antibody. A no-treatment control was also tested. The AK168 construct is an exemplary masked IL-2 polypeptide construct that includes a mutant form of an IL-2 polypeptide that eliminates or reduces CD25 binding. The AK167 construct is a parental, non-masked form of the AK168 construct that includes the same mutant IL-2 polypeptide. As shown in FIGS. 11A-11C, the non-masked AK167 construct demonstrated reduced STAT5 activation as compared to the rhIL-2 control, and the masked IL-2 polypeptide construct AK168 did not induce detectable STAT5 activation. FIG. 11D provides EC50 (pM) and fold-change data for the AK167, AK168 constructs, as well as the rhIL-2 control. The EC50 of the AK168 construct was non-detectable (n.d.).

Figure 12A:
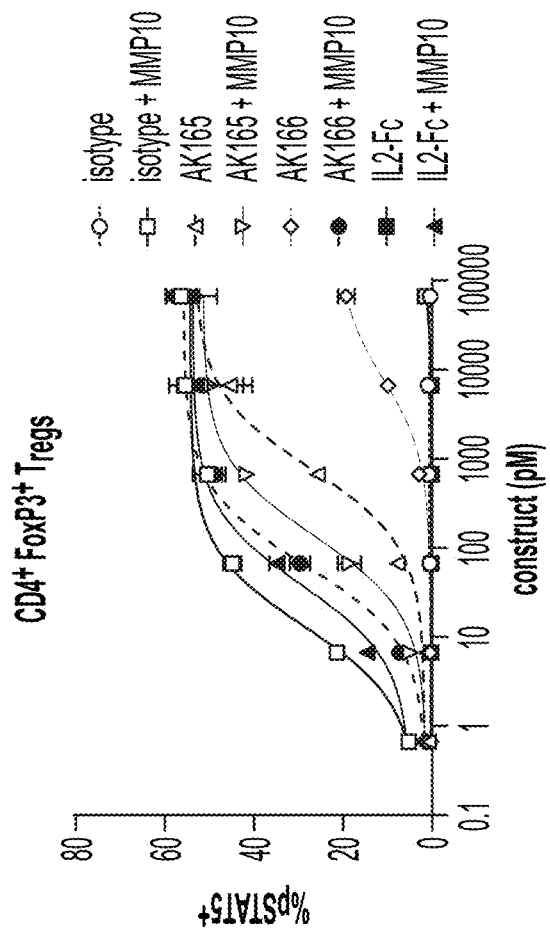
FIGS. 12A-12D show STAT5 activation (%) in PBMCs treated with the construct AK165 or AK166, or an isotype control or an IL-2-Fc control, that were (+MMP10) or were not previously exposed to the MMP10 protease. The key as shown in FIG. 12A also applies to FIG. 12B, and the key as shown in FIG. 12C also applies to FIG. 12D. STAT5 activation (%) is shown for CD4+FoxP3+ T regulatory cells (FIG. 12A), CD4+FoxP3- T helper cells (FIG. 12B), CD8+ cytotoxic T cells (FIG. 12C), and CD56+NK cells (FIG. 12D).
Figure 12B:
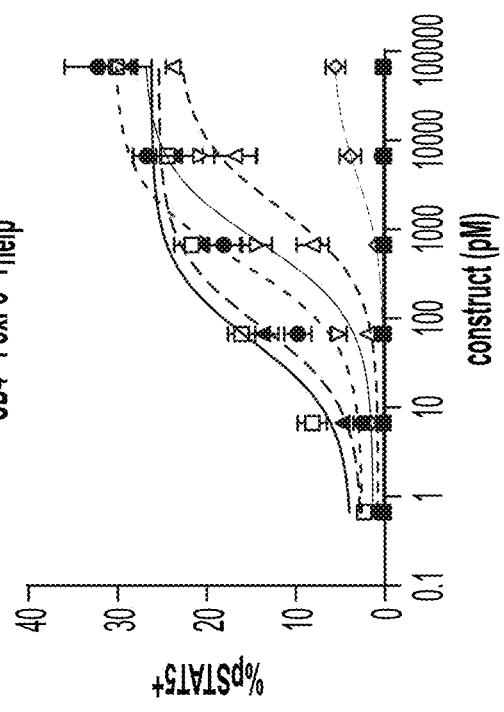
Figures 12C, 12D:
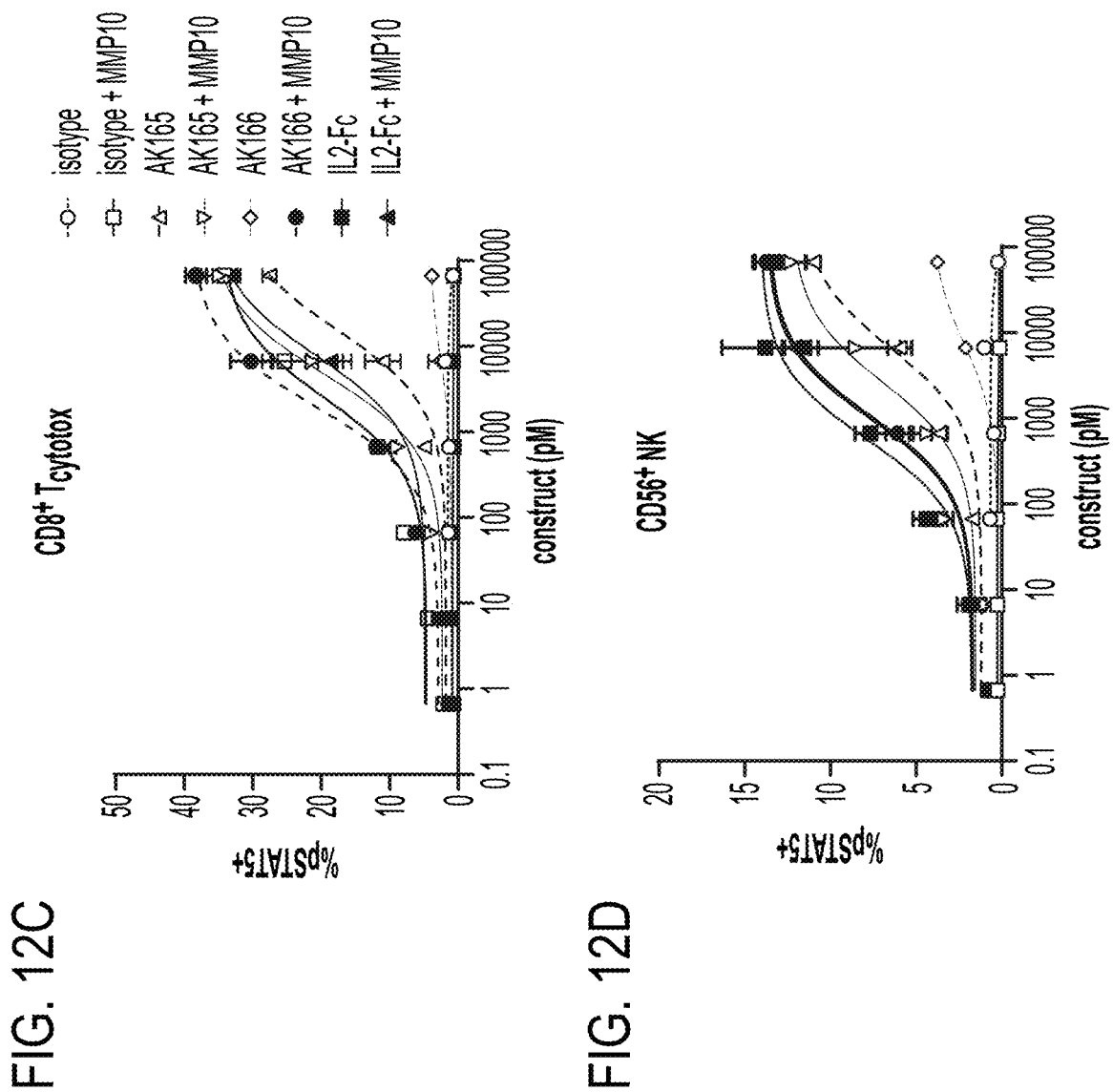

FIGS. 12A-12D depict the results from STAT5 activation studies, as described above, using the exemplary constructs AK165 and AK166, as well as an isotype control and an IL-2-Fc control, that were (+MMP10) or were not previously exposed to the MMP10 protease. The AK166 construct is an exemplary masked IL-2 polypeptide construct that includes a wildtype form of an IL-2 polypeptide (except for a C125A mutation). The AK165 construct is a parental, non-masked form of the AK166 construct that includes the same IL-2 polypeptide. The key as shown in FIG. 12A also applies to FIG. 12B, and the key as shown in FIG. 12C also applies to FIG. 12D. As shown in FIGS. 12A-12D STAT5 activation was greatly diminished for the masked AK166 construct (without protease cleavage), but was restored to levels resembling the IL2-Fc control following exposure to the activating protease MMP10.

FIGS. 13A-13C depict the results from STAT5 activation studies, as described above, using the exemplary constructs AK109 and AK110, as well as an isotype control and an IL-2-Fc control, that were (+MMP10) or were not previously exposed to the MMP10 protease. The AK109 and AK110 construct are exemplary masked IL-2 polypeptide constructs that include half-life extension moieties having different heterodimerization mutations. The key as shown in FIG. 13B also applies to FIG. 13A. As shown in FIGS. 13A-13C, STAT5 activation was greatly diminished for the masked AK109 and AK110 construct (without protease cleavage), but was greatly increased to levels approaching the IL2-Fc control following exposure to the activating protease MMP10.

Figures 14C, 14D:
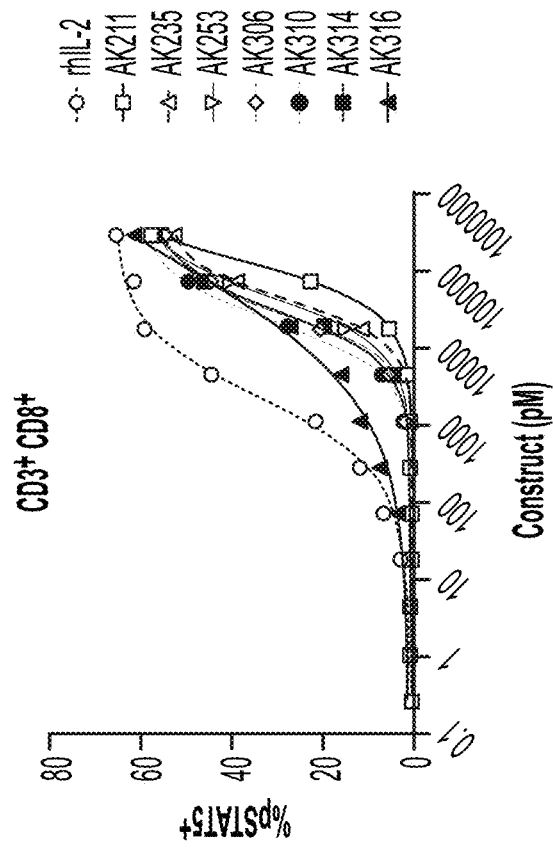

FIGS. 14A-14D depict the results from STAT5 activation studies, as described above, using the constructs AK211, AK235, AK253, AK306, AK310, AK314, and AK316, as well as an rhIL-2 control. This includes constructs that are parental, non-masked constructs (AK235, AK253, AK306, AK310, AK314) that include various mutations that modulate CD25 binding. FIG. 14D provides EC50 data for each of the tested constructs as well as the rhIL-2 control.

Figure 15A:
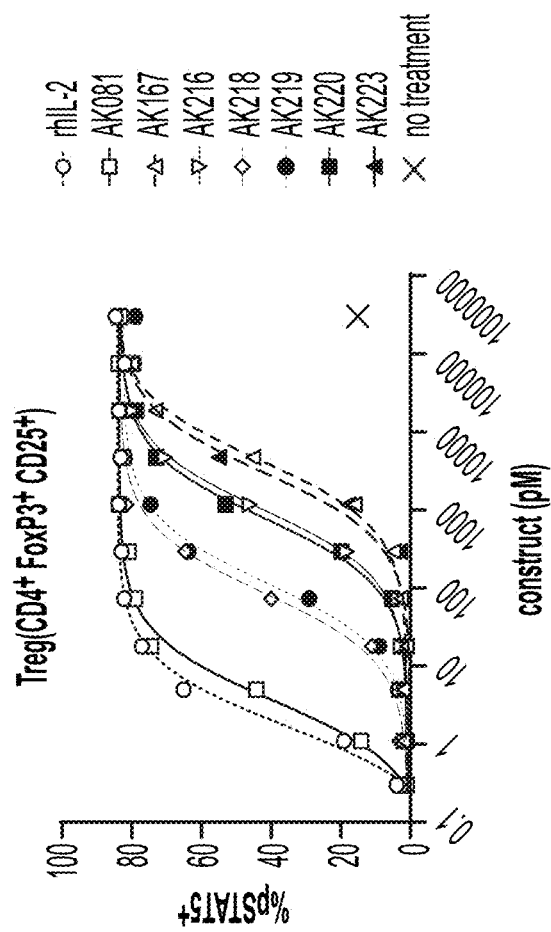
FIGS. 15A-15D show the results from STAT5 activation studies in PBMCs using the constructs AK081, AK167, AK216, AK218, AK219, AK220, and AK223 that have been activated by protease, as well as an rhIL-2 control. STAT5 activation (%) is shown for CD4+FoxP3+CD25+ regulatory T cells (FIG. 15A), CD4+FoxP3-CD25- cells (FIG. 15B), and CD8+ cells (FIG. 15C).
Figure 15B:
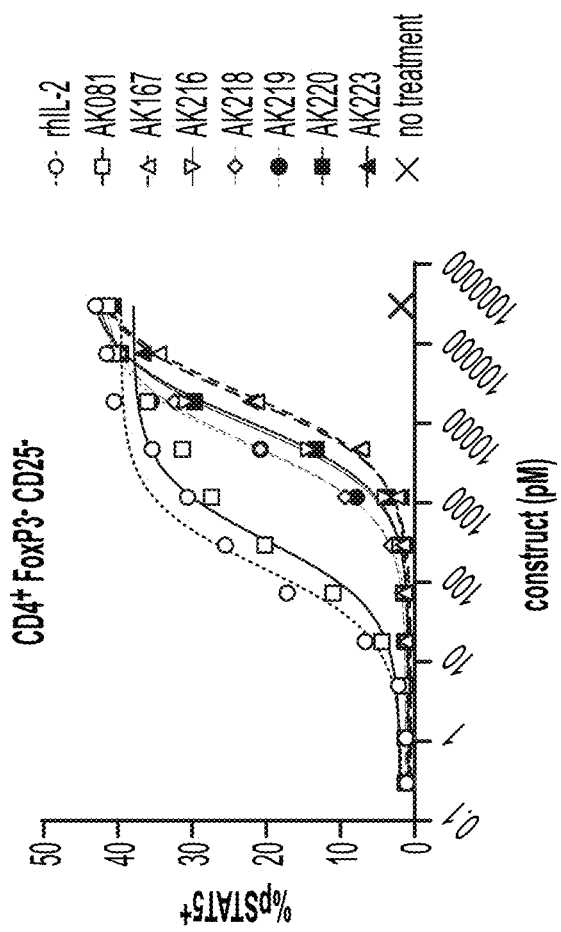
Figures 15C, 15D:
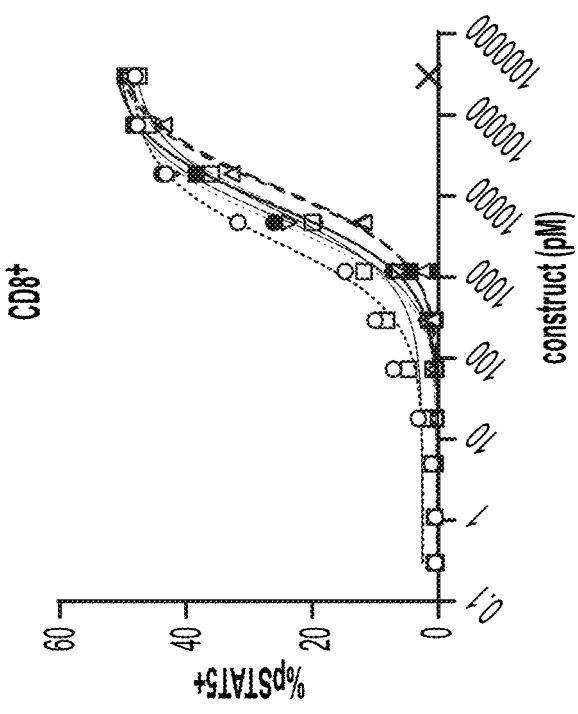

FIGS. 15A-15D depict the results from STAT5 activation studies, as described above, using the constructs AK081, AK167, AK216, AK218, AK219, AK220, and AK223 that have been activated by protease, as well as an rhIL-2 control. A no-treatment control was also tested. This includes masked IL-2 polypeptide constructs (AK216, AK218, AK219, AK220, and AK223) that include various mutations that modulate CD25 binding. The constructs were previously exposed to an activating protease prior to testing their ability to activate STAT5. FIG. 15D provides EC50 data for each of the tested constructs as well as the rhIL-2 control.

Figure 16A:
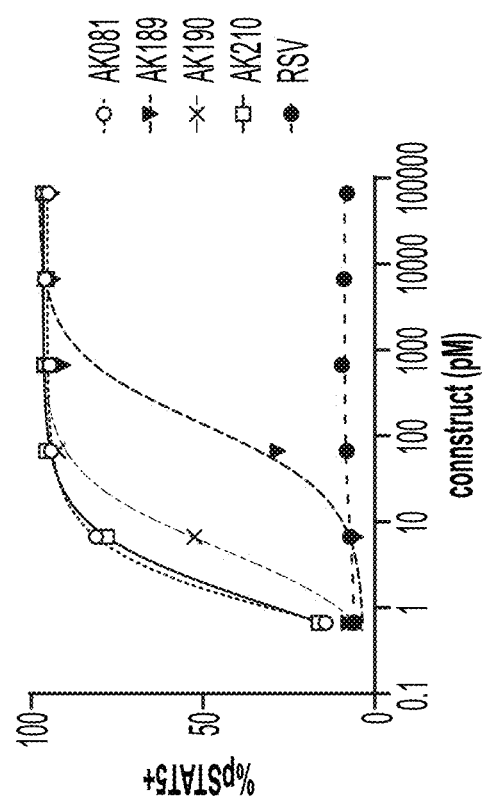
FIGS. 16A-16C show STAT5 activation (%) in PBMCs treated with the construct AK081, AK189, AK190, or AK210, or an anti-RSV control. The key as shown in FIG. 16A also applies to FIGS. 16B and 16C. STAT5 activation (%) is shown for regulatory T cells (FIG. 16A), CD4 helper T cells (FIG. 16B), and CD8 cells (FIG. 16C).
Figure 16C:
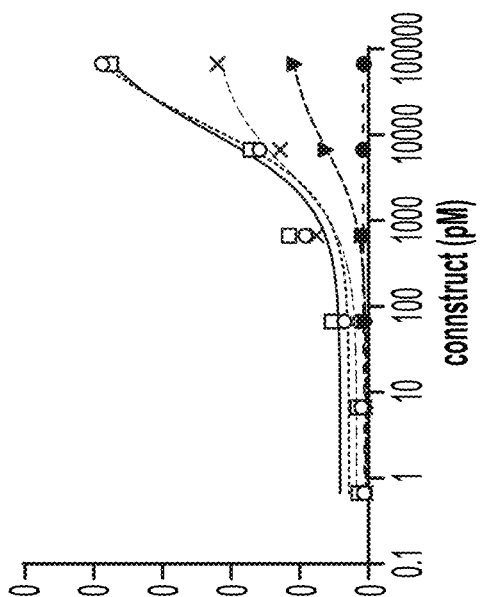
Figure 16B:
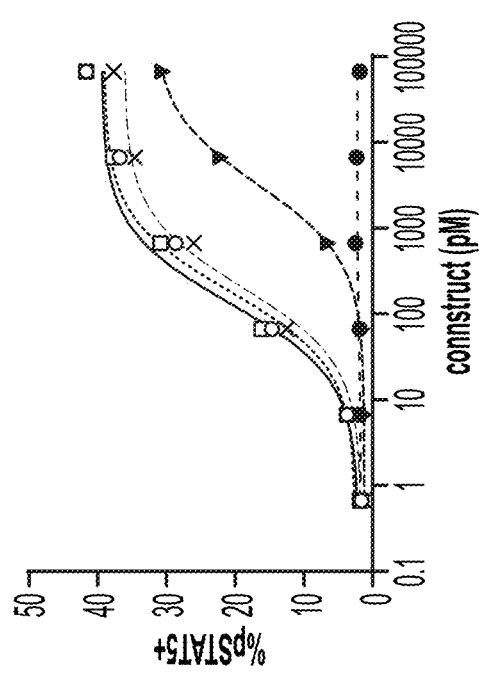

FIGS. 16A-16C depict the results from STAT5 activation studies, as described above, using the constructs AK081, AK189, AK190, and AK210, as well as an anti-RSV control. This includes masked IL-2 polypeptide constructs (AK189, AK190, AK210) that include an IL-2 polypeptide having a C125A mutation and include the same cleavable peptide sequence (RAAAVKSP; SEQ ID NO: 27) but having different linker sequences due to differences in the amino acid residues on the N-terminus of the protease cleavage sequence. The key as shown in FIG. 16A also applies to FIGS. 16B and 16C.

Figure 17A:
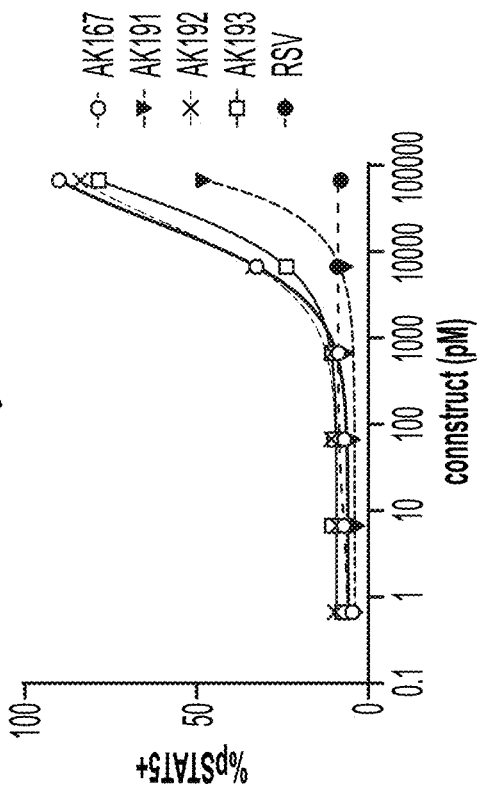
FIGS. 17A-17C show STAT5 activation (%) in PBMCs treated with the construct AK167, AK191, AK192, or AK193, or an anti-RSV control. The key as shown in FIG. 17A also applies to FIGS. 17B and 17C. STAT5 activation (%) is shown for regulatory T cells (FIG. 17A), CD4 helper T cells (FIG. 17B), and CD8 cells (FIG. 17C).
Figure 17B:
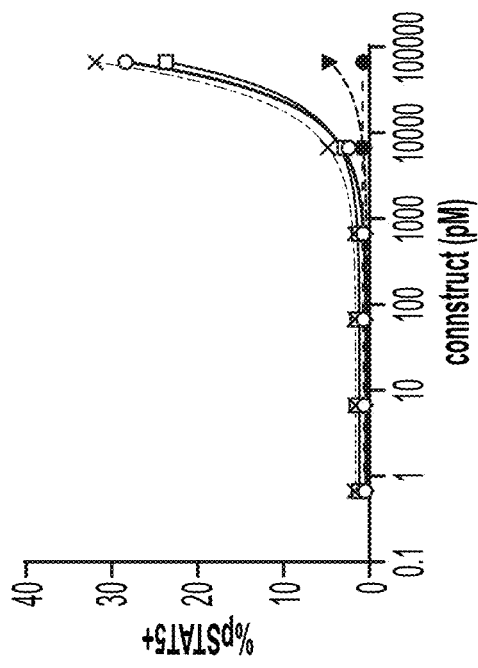
Figure 17C:
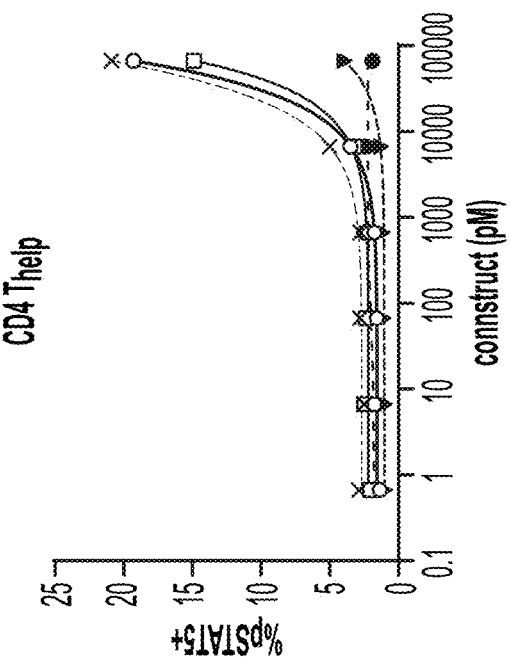

FIGS. 17A-17C depict the results from STAT5 activation studies, as described above, using the constructs AK167, AK191, AK192, and AK193, as well as an an anti-RSV control. This includes masked IL-2 polypeptide constructs (AK189, AK190, AK210) that include an IL-2 polypeptide having R38A, F42A, Y45A, E62A, and C125A mutations and include the same cleavable peptide sequence (RAAAVKSP; SEQ ID NO: 27) but having different linker sequences due to differences in the amino acid residues on the N-terminus of the protease cleavage sequence. The key as shown in FIG. 17A also applies to FIGS. 17B and 17C.

Example 3: In Vivo Characterization of Masked IL-2

Pharmacokinetics

The pharmacokinetics of the masked IL-2 polypeptide constructs generated in Example 1 is assessed in vivo using mouse models.

Mice are treated intravenously, intraperitoneally or subcutaneously with the constructs and the concentration of the construct in the plasma is measured over time. In some experiments, some mice are treated with controls for comparison. In some experiments, some mice are treated with aldesleukin as a control for masked IL-2 polypeptide treatment. In some experiments, the mice that are treated have tumors. In some experiments, the mice that are treated are tumor-free. In some experiments, mice are treated with the constructs and blood is drawn at various times over the course of treatment, which may include drawing blood prior to the initiation of treatment and processing it to obtain plasma. In some experiments, blood is drawn at various time points over the course of two weeks, three weeks, or four weeks or more of treatment. In some experiments, the mean plasma concentration of the administered constructs, as well as aldesleukin and/or other controls, is measured. Masked IL-2 polypeptide constructs are detected in the plasma samples after dilution into PBS Tween with IL-2- and human Fc-specific ELISAs and are quantified using a standard curve generated for each construct. The percentage of full length and cleaved constructs is determined by western blot with anti-huFc-HRP and anti-huIL-2-HRP and by whole mass and peptide mass spectrometry.

The pharmacokinetics of the masked IL-2 polypeptide constructs in tumors is also assessed in vivo using mouse models. Mice having tumors are treated intravenously or subcutaneously with the constructs and the concentration of the construct in tumors of the mice is assessed. In some experiments, some mice are treated with controls for comparison. In some experiments, some mice are treated with aldesleukin as a control for masked IL-2 polypeptide treatment. Tumors are analyzed for the presence of the constructs as well as the presence of particular proteases. In some experiments, the tumors are analyzed for the presence and percentage of full length and cleaved constructs.

Some pharmacokinetic studies were carried out according to the following method. C57BL/6 female mice were purchased from Charles River Laboratories and were 8-10 weeks old at the start of study. MC38 tumor cells ($5 \times 10^5$ cells per mouse) were injected subcutaneously into the right flank of each mouse. Upon reaching ~100 mm$^3$ sized tumors (day 0), the mice received a single 2 mg/kg intravenous dose of the construct of interest (e.g., a non-masked parental IL-2 polypeptide construct, a masked IL-2 polypeptide construct, or a non-cleavable masked IL-2 polypeptide construct) in PBS. Constructs tested include, for instance, AK032, AK081, AK111, AK167, AK168, AK191, AK197, AK203, AK209, and AK211. Plasma were collected at 5 min, days 1, 2 and 5 after dosing. Drug levels were determined using ELISAs utilizing anti-human IgG (clone M1310G05, Biolegend) as the capture antibody and various detection antibodies. HRP or biotin conjugated detection antibodies against human IgG (ab97225, Abcam) or CD122 (clone 9A2, Ancell) and IL-2 (Poly5176, Biolegend) were utilized to detect total and non-cleaved drug levels, respectively.

Figure 18A:
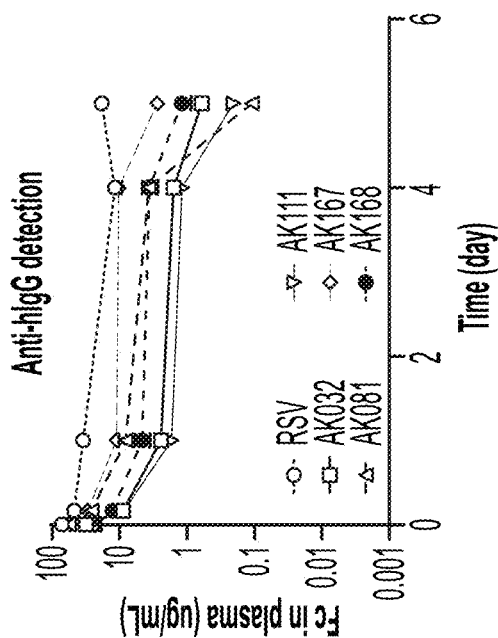
FIGS. 18A-18D show results from pharmacokinetic studies carried out in tumor-bearing mice using the construct AK032, AK081, AK111, AK167, or AK168, or an anti-RSV control.
Figure 18B:
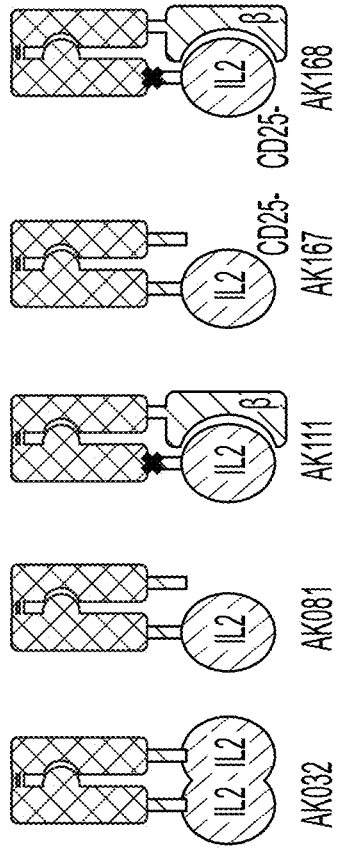
Figure 18C:
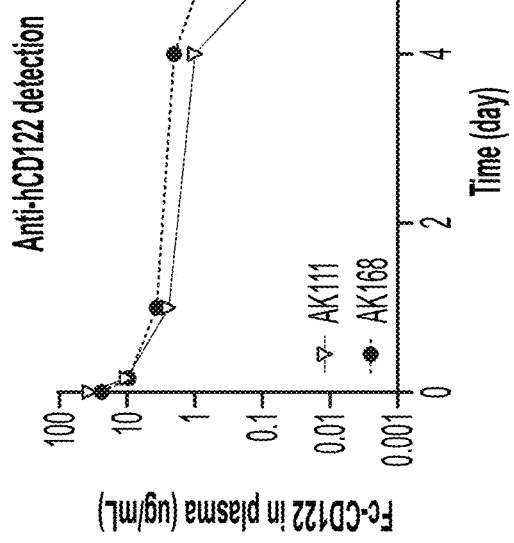
Figure 18D:
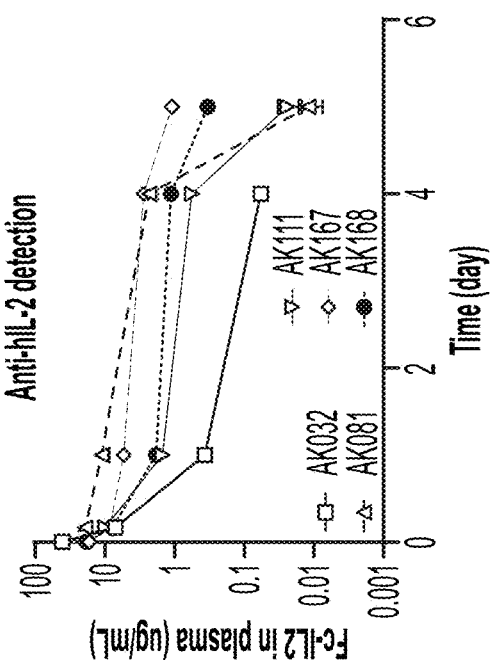

FIGS. 18A-18D describe results from pharmacokinetic studies carried out, as described above, in tumor-bearing mice using the constructs AK032, AK081, AK111, AK167, and AK168, as well as an anti-RSV control. FIG. 18A provides a simplistic depiction of the structure of each of the constructs tested. As indicated, AK111 and AK168 are exemplary masked IL-2 polypeptide constructs. The AK167 and AK168 constructs include mutations (R38A, F42A, Y45A, and E62A) that eliminate or reduce binding to CD25. FIG. 18A shows Fc levels in plasma (μg/mL) by detecting human IgG, FIG. 18C shows Fc-CD122 levels in plasma (μg/mL) by detecting human CD122, and FIG. 18D shows Fc-IL2 levels in plasma (μg/mL) by detecting human IL-2.

Figure 19A:
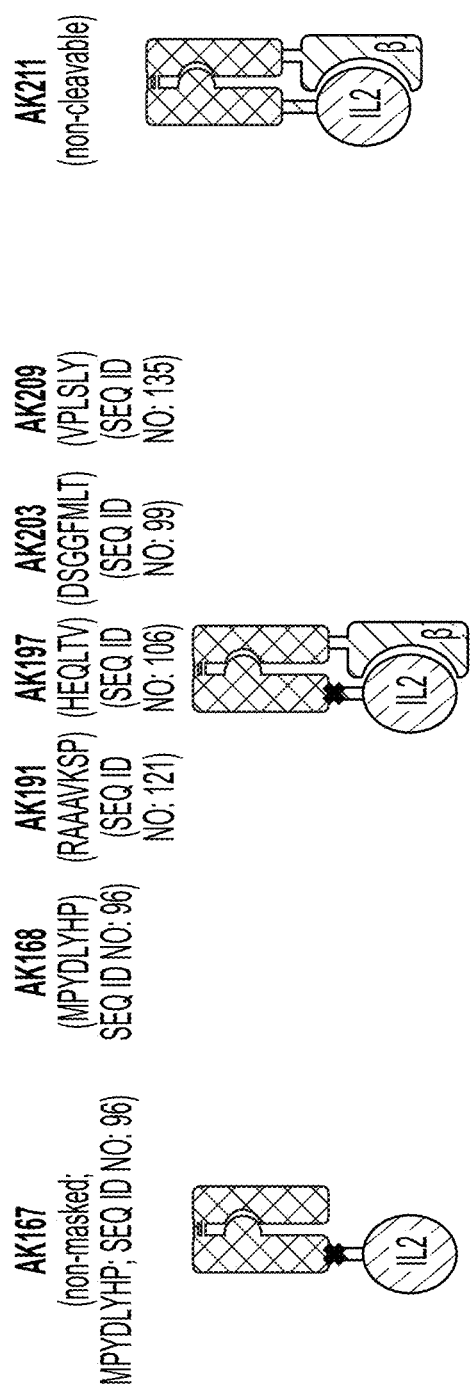
Figure 19B:
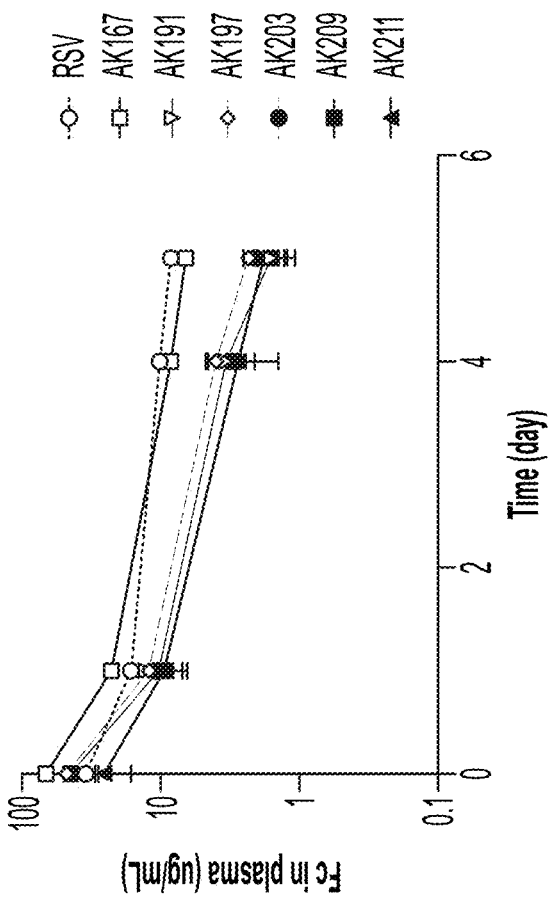
Figure 20F:
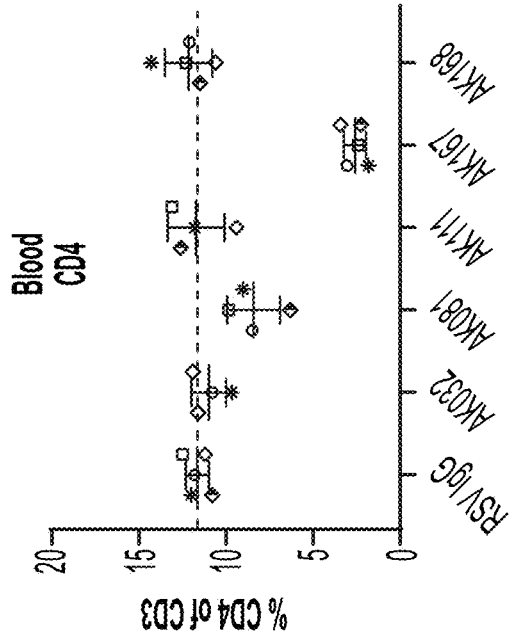
Figure 20H:
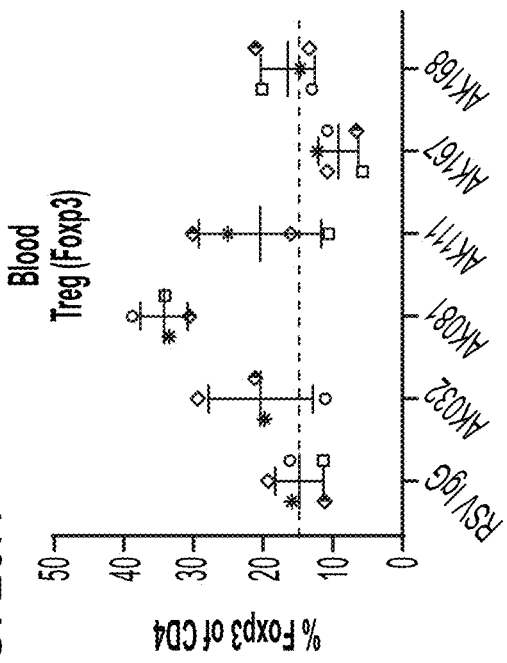
Figure 20E:
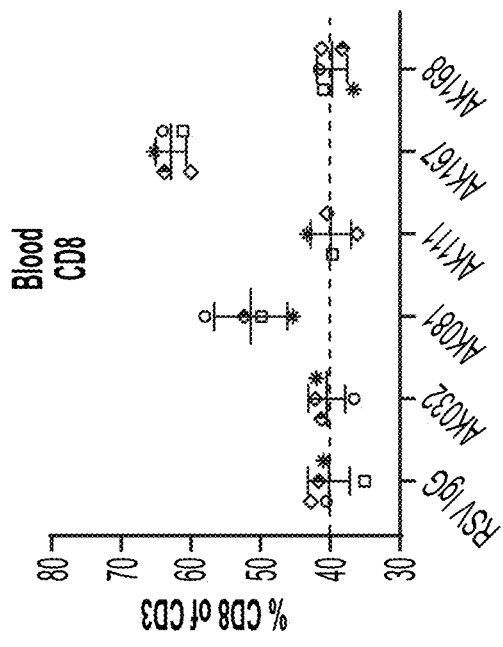
Figure 20G:
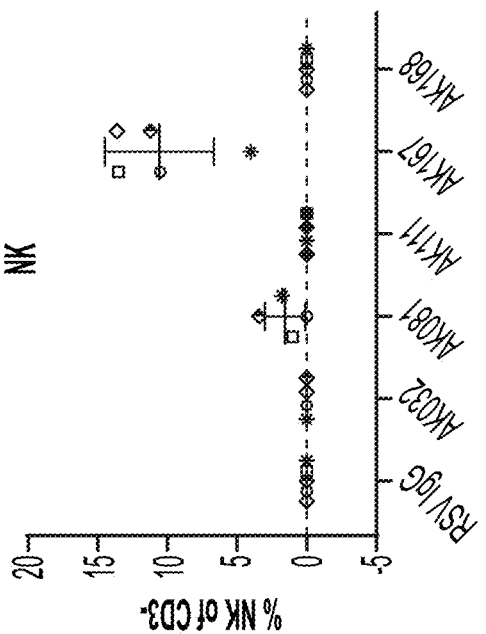
Figure 20J:
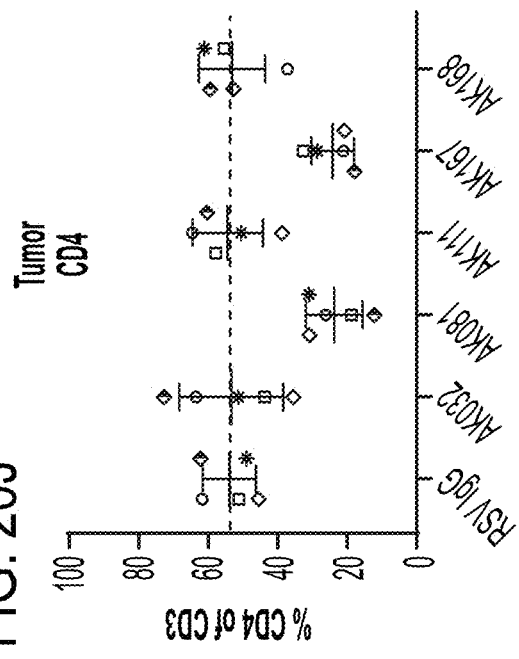
Figure 20I:
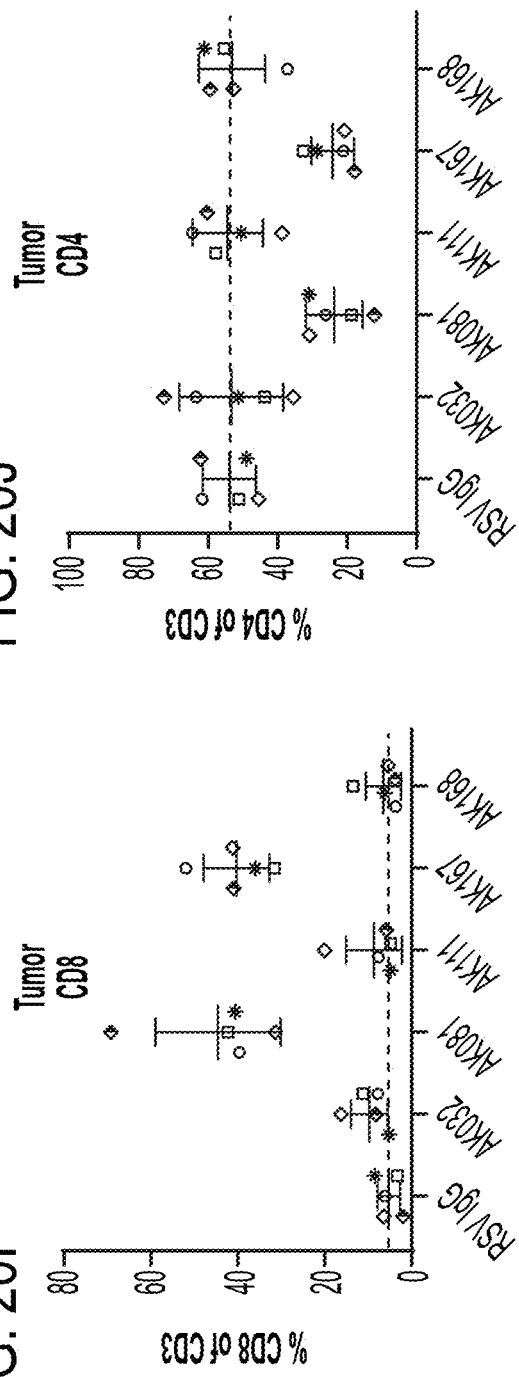
Figure 20L:
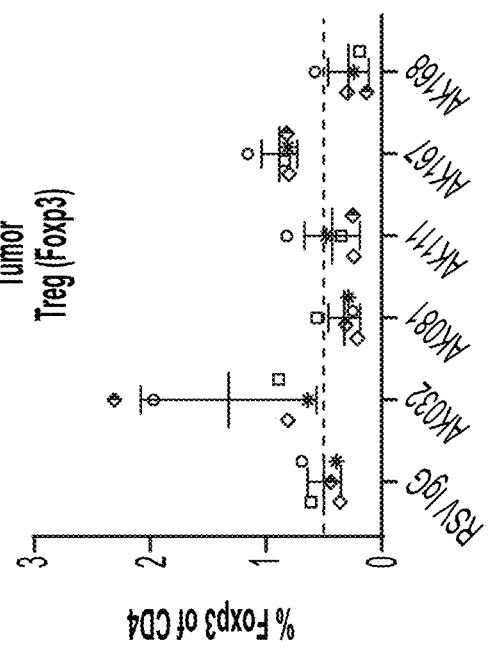
Figure 20K:
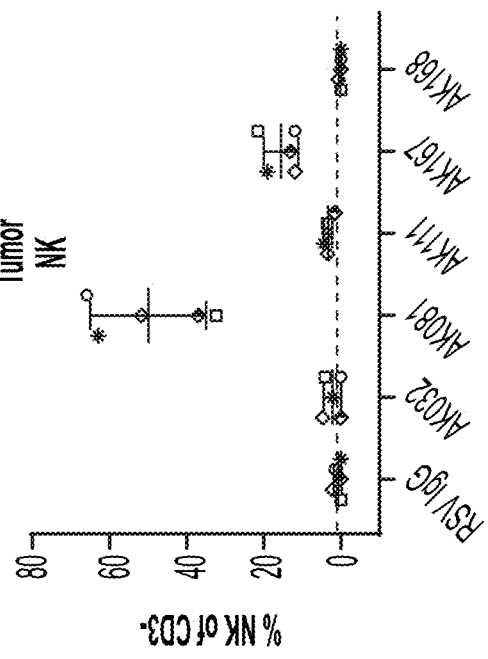
Figure 21B:
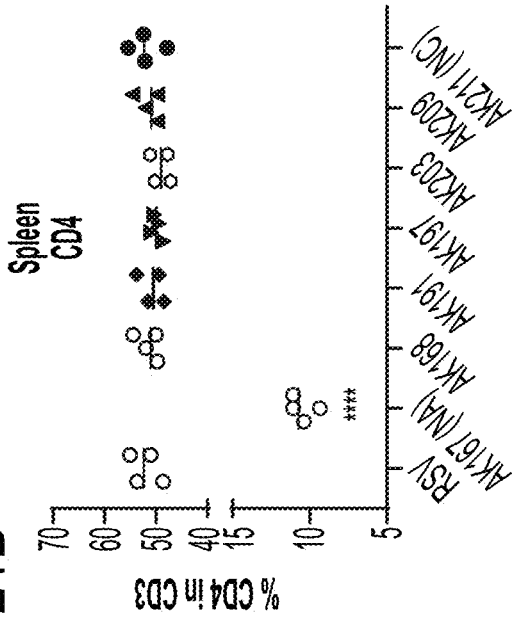
FIGS. 21A-21L show results from studies testing the in vivo responses of CD4, CD8, NK, and Treg percentages in spleen, blood, and tumor, using the AK167, AK168, AK191, AK197, AK203, AK209, or AK211 construct, or an anti-RSV IgG control. For spleen tissue, % CD8 cells of CD3 cells (FIG. 21A), % CD4 of CD3 cells (FIG. 21B), % NK cells of CD3− cells (FIG. 21C), % FoxP3 of CD4 cells (FIG. 21D) is shown. For blood, % CD8 cells of CD3 cells (FIG. 21E), % CD4 of CD3 cells (FIG. 21F), % NK cells of CD3− cells (FIG. 21G), % FoxP3 of CD4 cells (FIG. 21H) is shown. For tumor tissue, % CD8 cells of CD3 cells (FIG. 21I), % CD4 of CD3 cells (FIG. 21J), % NK cells of CD3− cells (FIG. 21K), % FoxP3 of CD4 cells (FIG. 21L) is shown.
Figure 21D:
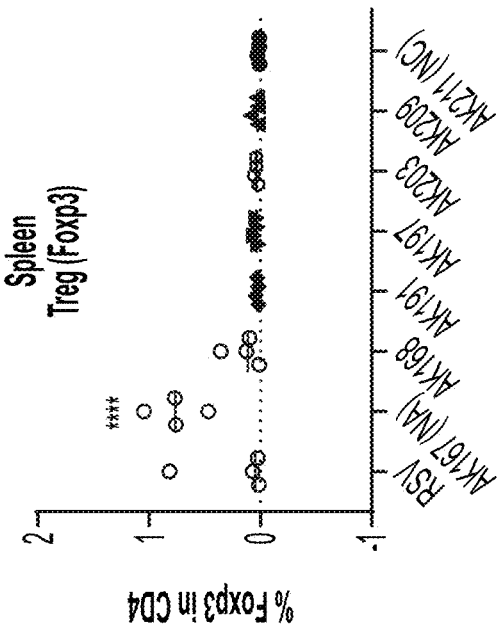
Figure 21A:
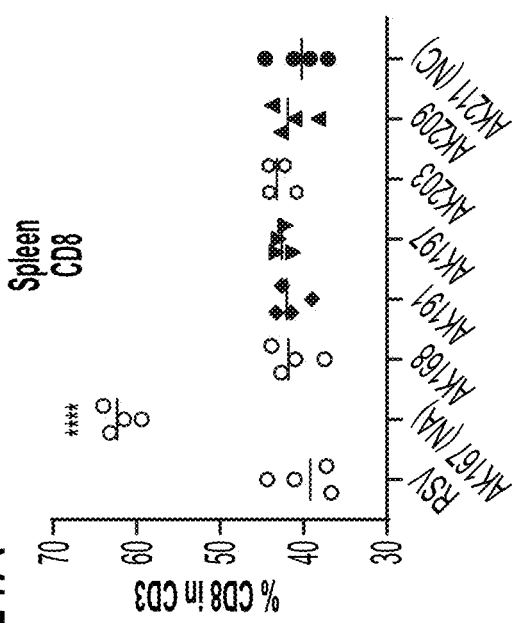
Figure 21C:
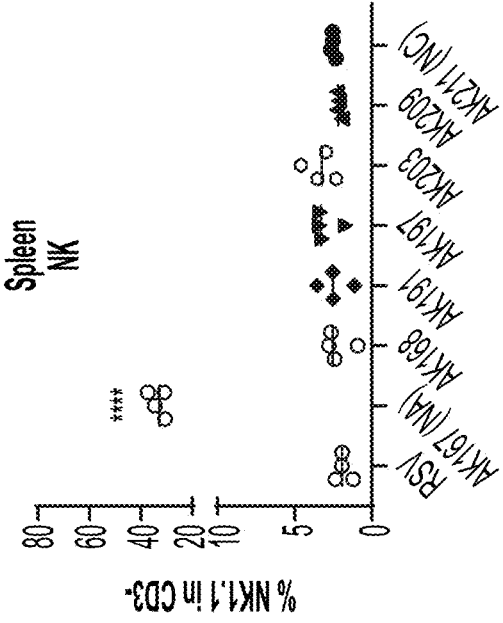
Figure 21F:
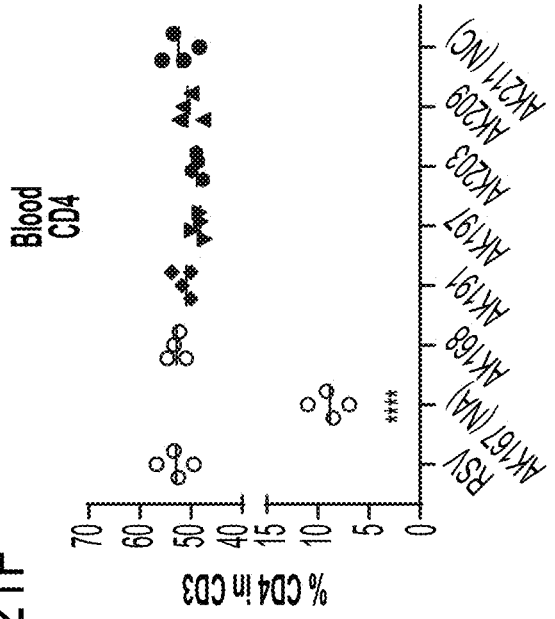
Figure 21H:
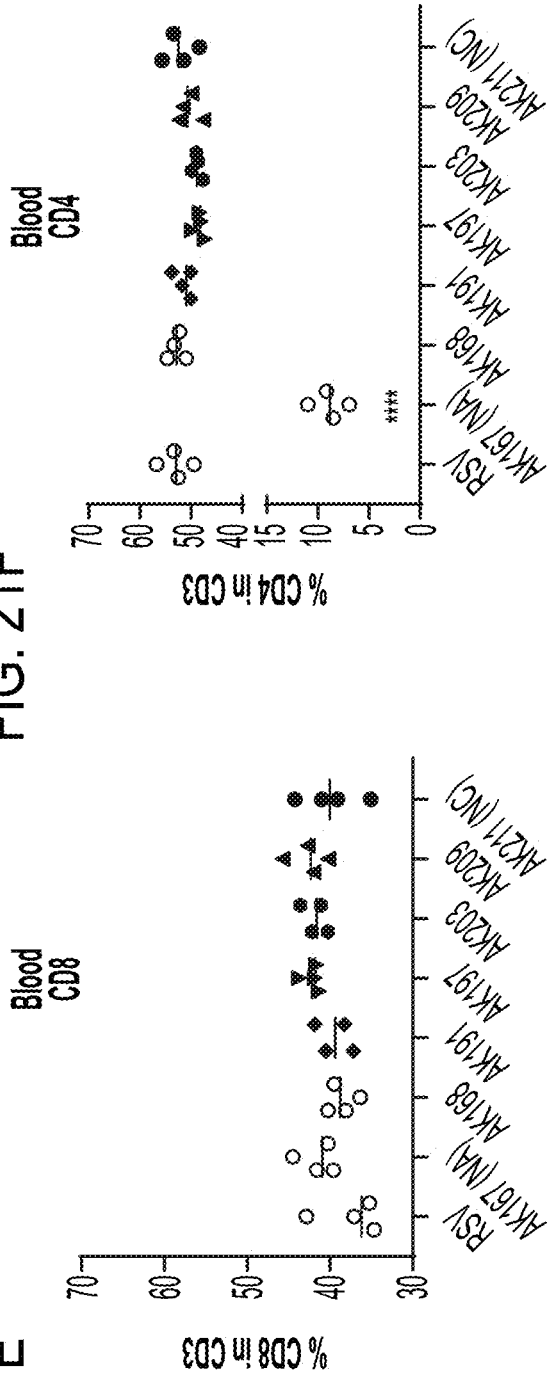
Figure 21E:
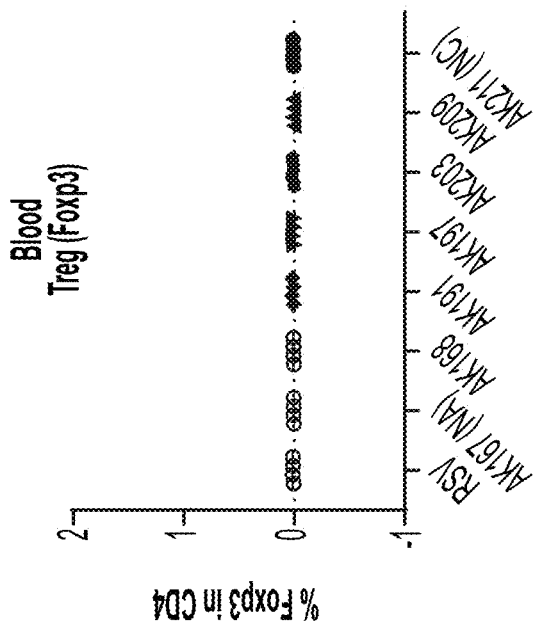
Figure 21G:
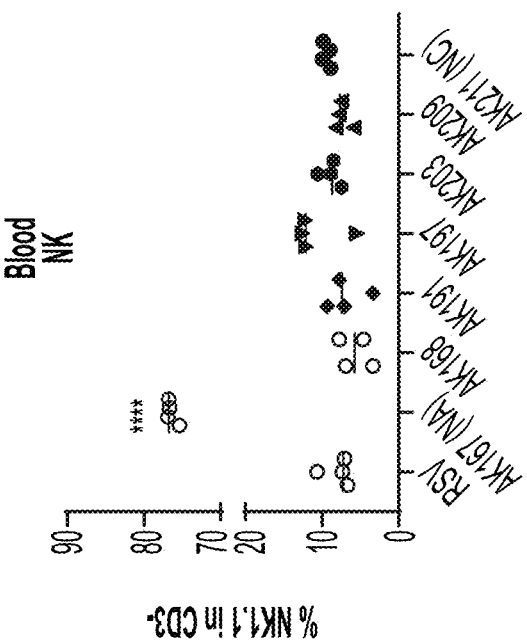
Figure 21J:
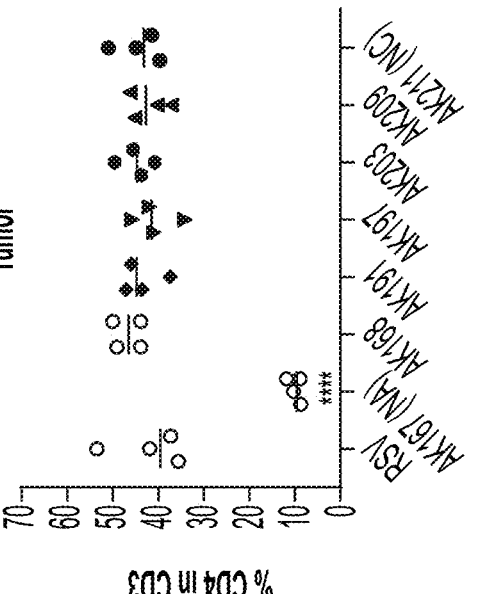
Figure 21I:
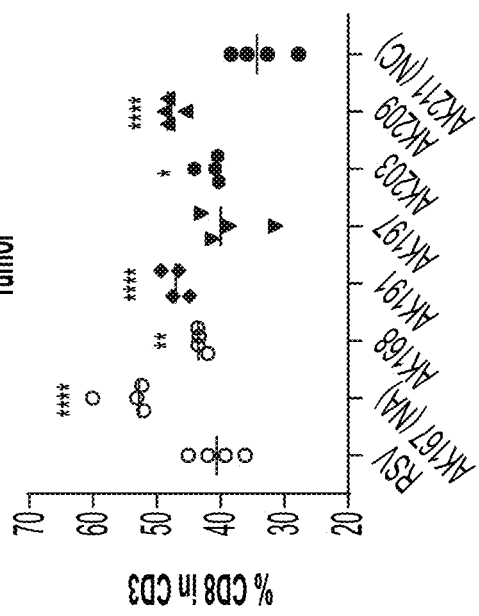
Figure 21L:
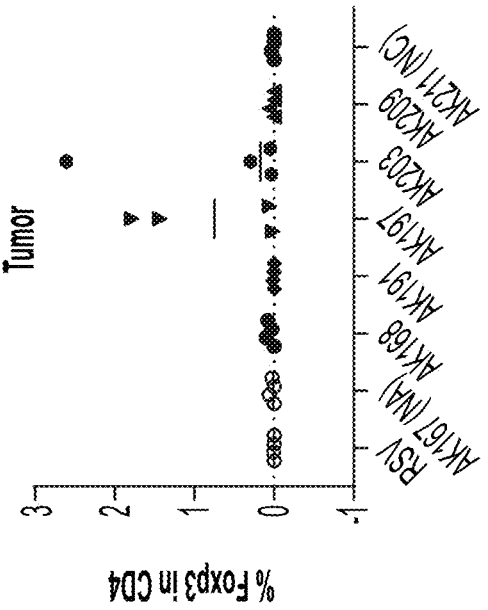
Figure 21K:
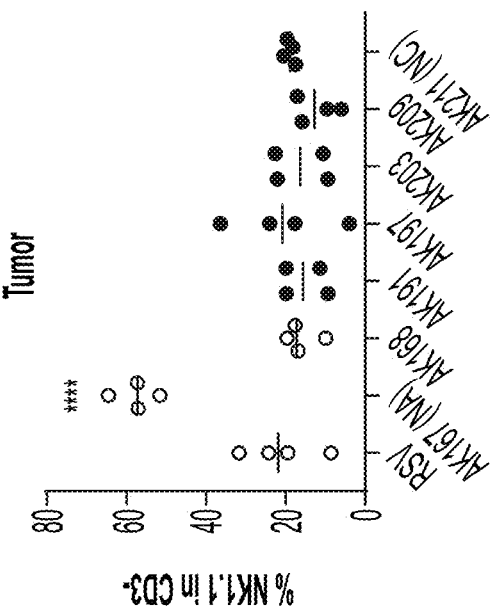
Figure 22B:
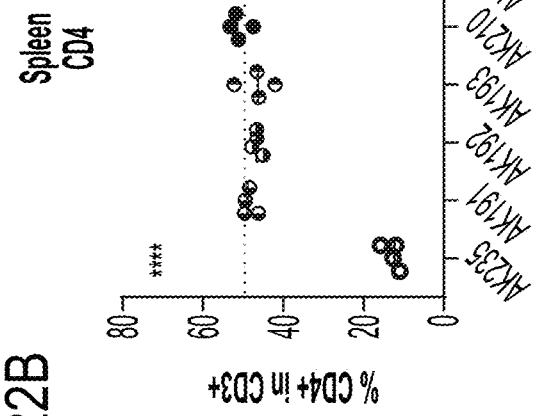
FIGS. 22A-22L show results from studies testing the in vivo responses of CD4, CD8, NK, and Treg percentages in spleen, blood, and tumor, using the AK235, AK191, AK192, AK193, AK210, AK189, AK190, or AK211 construct, or an anti-RSV IgG control. For spleen tissue, % CD8 cells of CD3 cells (FIG. 22A), % CD4 of CD3 cells (FIG. 22B), % NK cells of CD3− cells (FIG. 22C), % FoxP3 of CD4 cells (FIG. 22D) is shown. For blood, % CD8 cells of CD3 cells (FIG. 22E), % CD4 of CD3 cells (FIG. 22F), % NK cells of CD3− cells (FIG. 22G), % FoxP3 of CD4 cells (FIG. 22H) is shown. For tumor tissue, % CD8 cells of CD3 cells (FIG. 22I), % CD4 of CD3 cells (FIG. 22J), % NK cells of CD3− cells (FIG. 22K), % FoxP3 of CD4 cells (FIG. 22L) is shown.
Figure 22D:
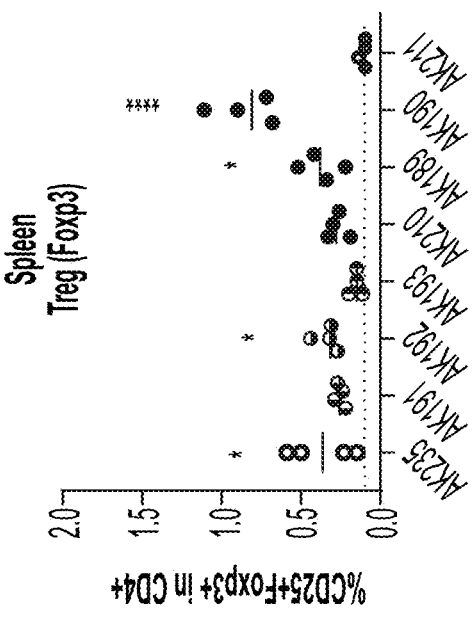
Figure 22A:
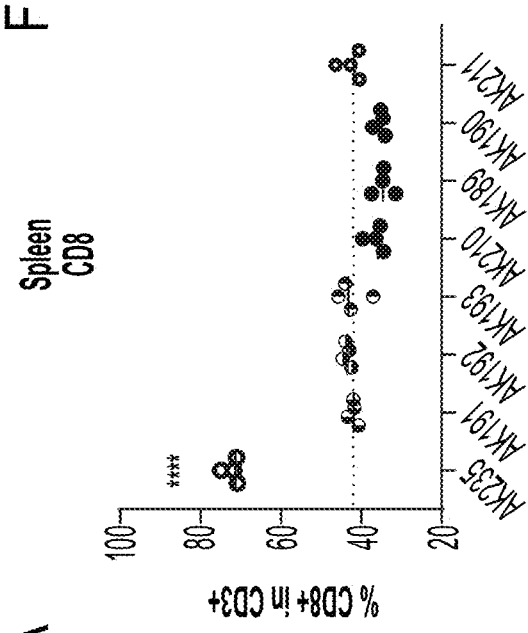
Figure 22C:
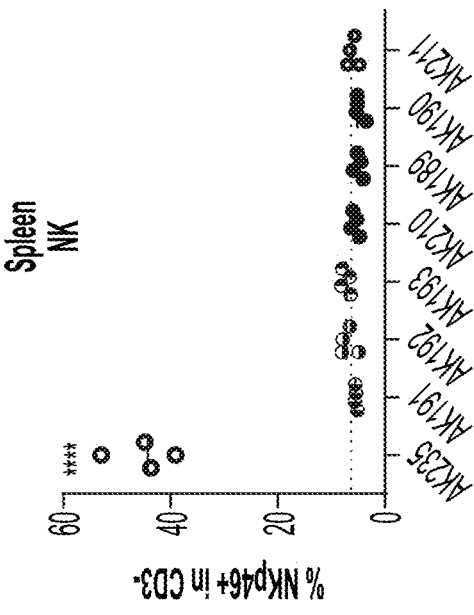
Figure 22F:
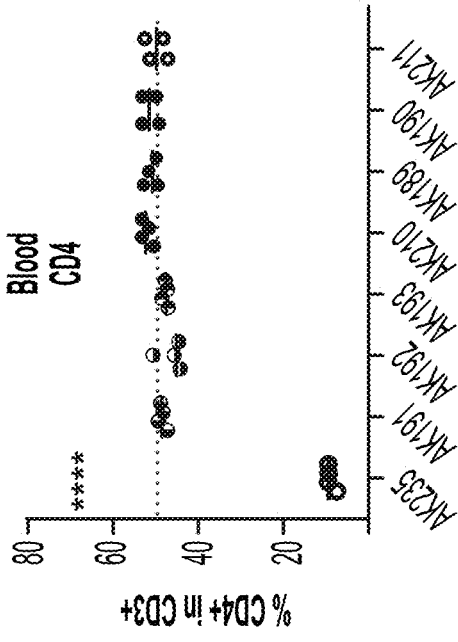
Figure 22H:
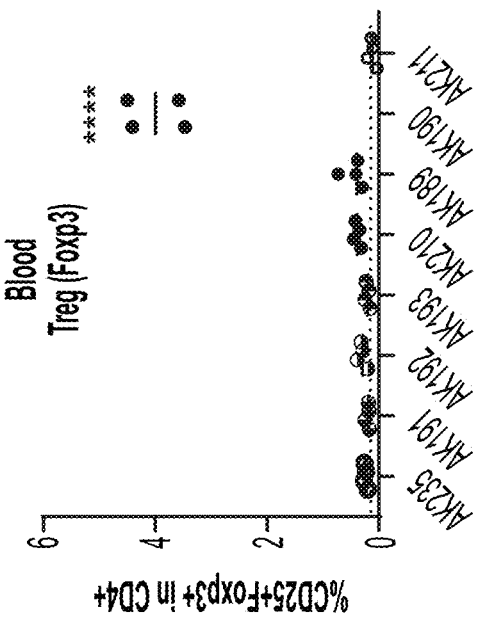
Figure 22E:
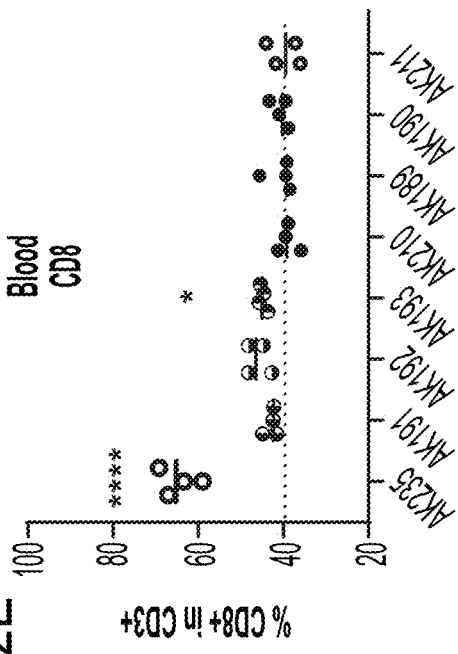
Figure 22G:
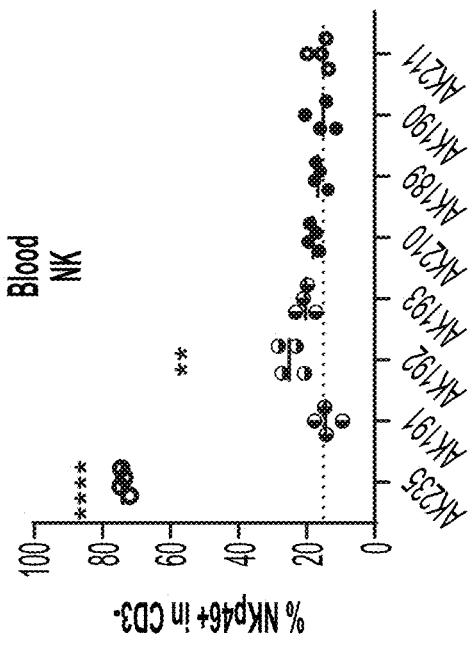
Figure 22J:
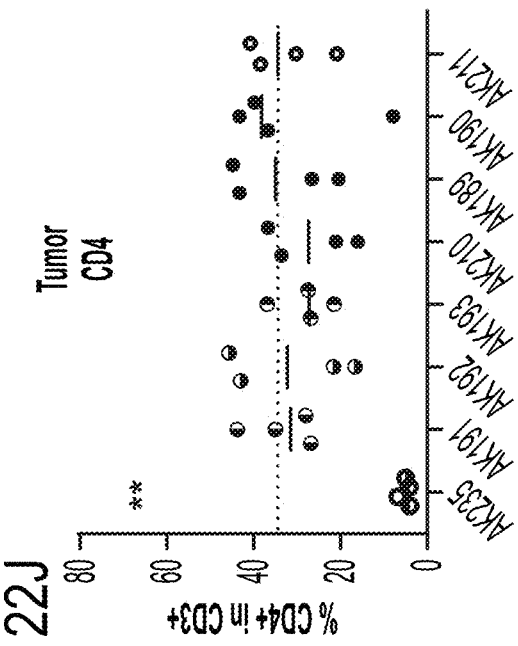
Figure 22I:
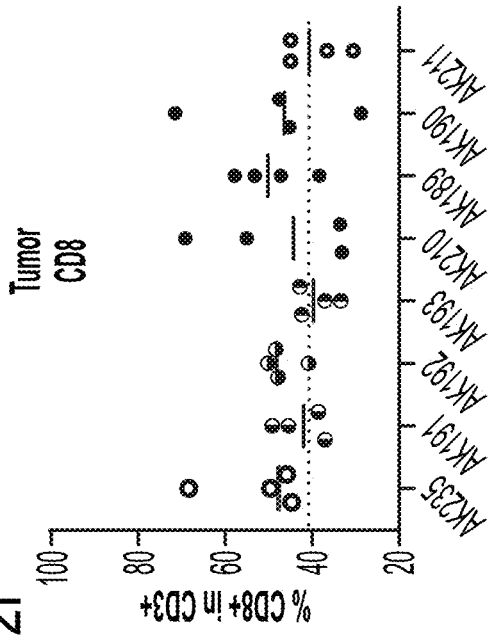
Figure 22L:
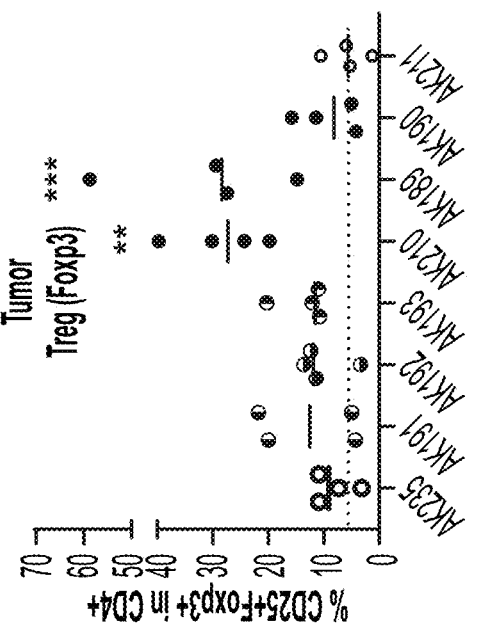
Figure 22K:
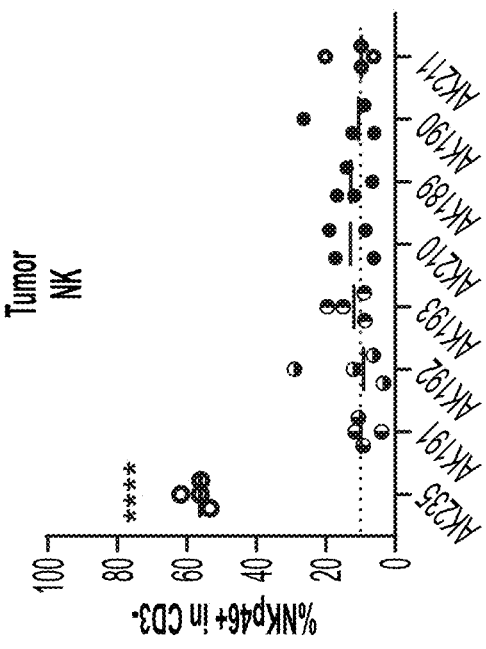
Figure 23H:
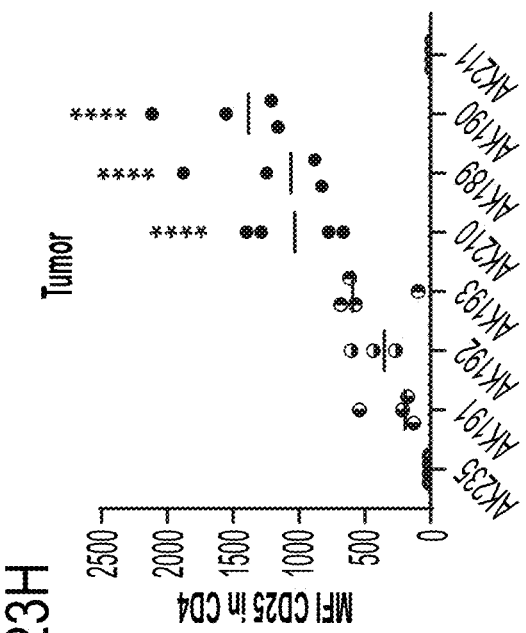
Figure 23G:
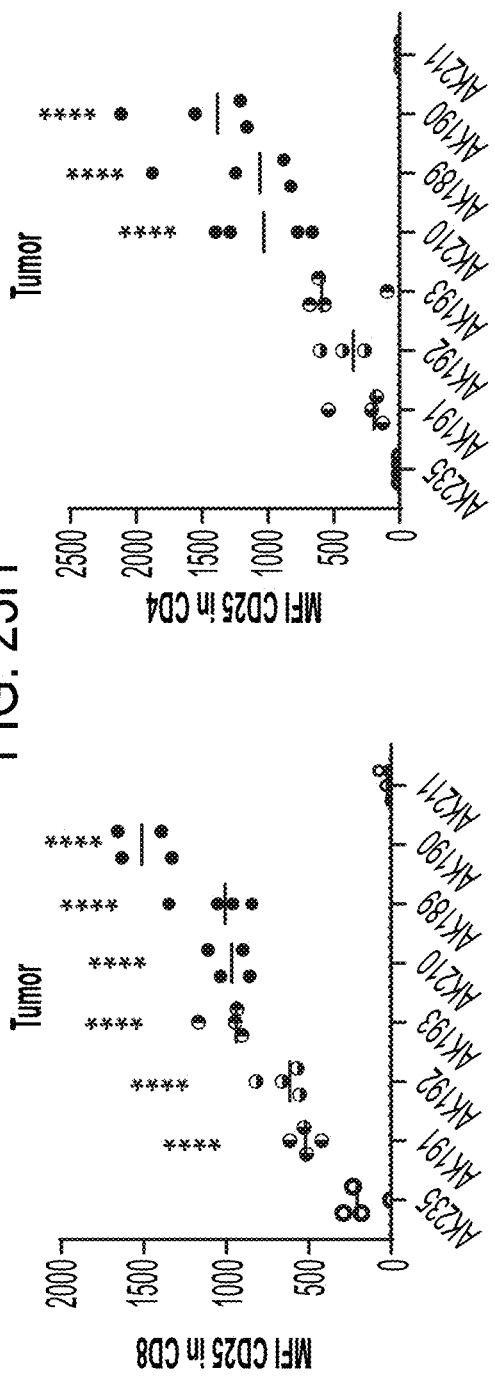
Figure 23I:
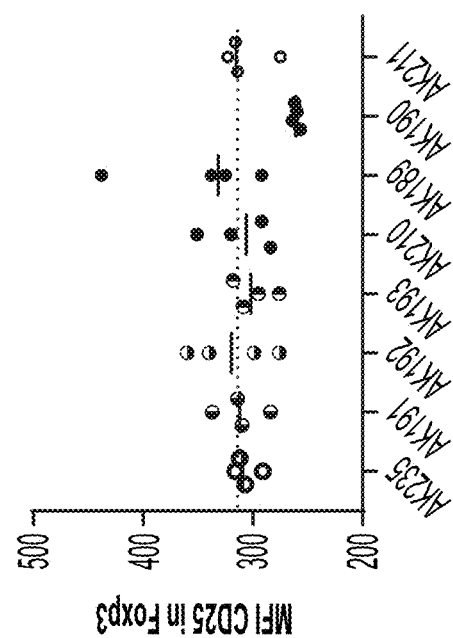

FIGS. 19A-19D describe results from pharmacokinetic studies carried out, as described above, in tumor-bearing mice using the constructs AK167, AK191 AK197, AK203, AK209, and AK211, as well as an anti-RSV control. FIG. 19A provides a simplistic depiction of the structure of each of the constructs tested. As indicated, AK168, AK191, AK197, AK203, and AK209 are exemplary masked IL-2 polypeptide constructs that each include a different cleavable peptide sequence in the linker connecting the IL-2 polypeptide to the half-life extension moiety. FIG. 19B shows Fc levels in plasma (μg/mL) by detecting human IgG, FIG. 19C shows Fc-IL2 levels in plasma (μg/mL) by detecting human IL-2, and FIG. 19D shows Fc-CD122 levels in plasma (μg/mL) by detecting human CD122. As shown in FIGS. 19B, 19C and 19D, the Fc levels, Fc-IL2 levels, and Fc-CD122 levels in the plasma are similar among the masked IL-2 polypeptide constructs tested.

Bioactivity in Mice

The in vivo bioactivity of the masked IL-2 polypeptide constructs generated in Example 1 is assessed in vivo using mouse models, such as C57BL/6 mice. Mice are treated with the constructs and in vivo bioactivity is assessed. In some experiments, some mice are treated with controls for comparison. In some experiments, some mice are treated with aldesleukin as a control for masked IL-2 polypeptide treatment. In some experiments, the mice that are treated have tumors. In some experiments, the mice that are treated are tumor-free. In some experiments, the dose-dependent expansion of immune cells is assessed in the mice. In some experiments, the mice are treated with various doses of a construct, aldesleukin, or other control. In some experiments, the mice are treated over the course of two weeks. Blood is collected from the mice at various time points and is then stained using antibodies to immune cell markers of interest. In some experiments, the longitudinal kinetics of the proliferation and expansion of certain circulating cell types, such as CD8+ T cells, NK cells, and Treg cells, is also determined, as well as the ratio of CD8+ T cells and NK cells to CD4+CD25+FoxP3+ Treg cells. In some experiments, the mice are assessed for vascular leakage, such as by assessing for edema and lymphocyte infiltration in certain organs like the lung and liver as determined by organ wet weight and histology.

In some studies, vascular leakage was assessed in order to assess potential toxicity-related effects mediated by IL-2 based therapies by performing the following method. Repeated dose toxicity studies were conducted using C57BL/6 female mice that were purchased from Charles River Laboratories and were 8-10 weeks old weighing 18-22 grams at the start of study. Groups of 5 mice received daily intraperitoneal injections of masked and non-masked IL-2 constructs in PBS daily for 4 or 5 days. The constructs tested included AK081, AK111, AK167, and AK168. A control antibody was also administered as a control. Two hours after the last dose, all mice received an intravenous injection of 0.1 ml of 1% Evans blue (Sigma, cat #E2129) in PBS. Two hours after Evans blue administration, mice were anesthetized and perfused with 10 U/ml heparin in PBS. Spleen, lung and liver were harvested and fixed in 3 ml of 4% PFA 2 days at 4° C. prior to measuring the absorbance of the supernatant at 650 nm with NanoDrop OneC (Thermo Fisher Scientific, Waltham, MA) as an indicator of vascular leak of Evans blue. Fixed organs were embedded in paraffin, sectioned, and stained with hematoxylin and eosin. Histopathological studies and quantification were carried out by NovoVita Histopath Laboratory, LLC. (Allston, MA) according to standard procedures. FIGS. 25A-50D depict results from an in vivo study as described above for assessing vascular leakage using the exemplary masked IL-2 polypeptide constructs AK111 and AK168, as well as the non-masked IL-2 polypeptide constructs AK081 and AK167, and an anti-RSV control. FIG. 25A shows the percentage (%) of body weight loss, and FIGS. 25B, 25C and 25D shows the weight in grams of the liver, lung, and spleen, respectively, for each.

Figure 26A:
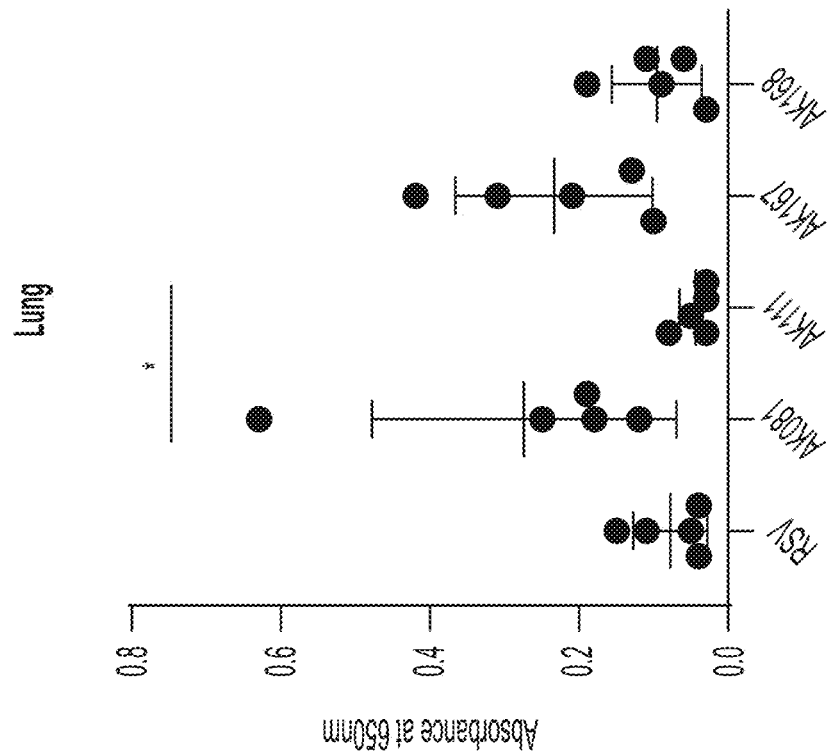
FIGS. 26A and 26B show results from an in vivo study that assessed vascular leakage as indicated by measuring the extent of dye leakage into liver and lung tissue following administration of the AK081, AK111, AK167, or AK168 construct, or an anti-RSV control. The extent of dye leakage into liver (FIG. 26A) and lung (FIG. 26B) was measured based on absorbance at 650 nm.
Figure 26B:
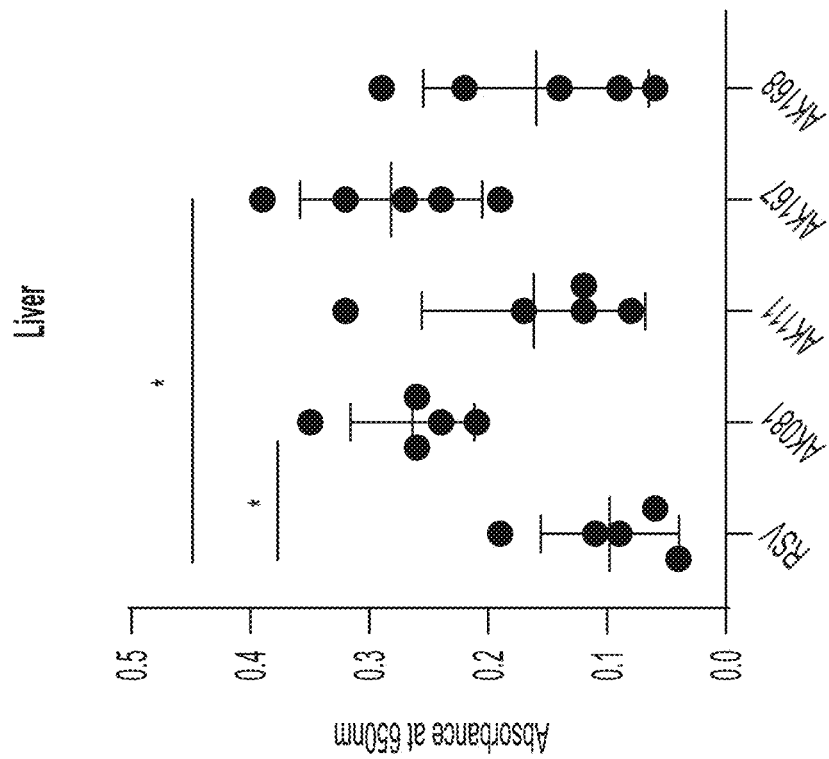

Vascular leakage as indicated by measuring the extent of dye leakage into tissues was also assessed for the AK081, AK111, AK167, and AK168 constructs, along with an anti-RSV control, with results shown in FIGS. 26A and 26B for the liver and lung, respectively. The extent of dye leakage was measured based on absorbance at 650 nm.

Figures 27A, 27B:
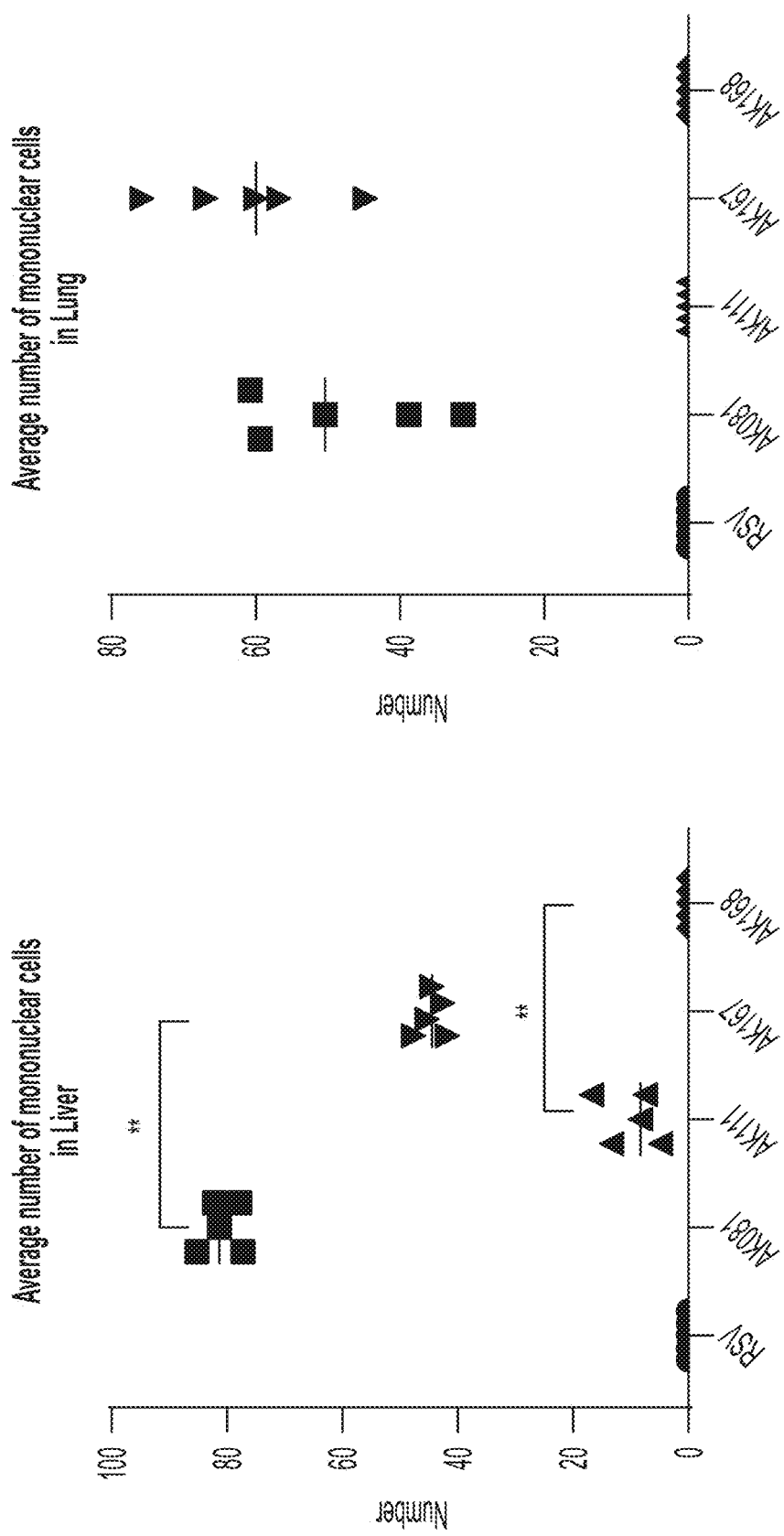
FIGS. 27A and 27B show results from an in vivo study that assessed vascular leakage as indicated by measuring the extent of mononuclear cell perivascular invasion into the liver and lung tissue following administration of the AK081, AK111, AK167, or AK168 construct, or an anti-RSV control. The average number of mononuclear cells in the liver (FIG. 27A) and the average number of mononuclear cells in the lung (FIG. 27B) depicted for each.

Vascular leakage as indicated by measuring the extent of mononuclear cell perivascular invasion into the liver and lung was also assessed for the AK081, AK111, AK167, and AK168 constructs, along with an anti-RSV control, with results shown in FIGS. 27A and 27B for the liver and lung, respectively. The average number of mononuclear cells in the liver (FIG. 27A) and the average number of mononuclear cells in the lung (FIG. 27B) depicted for each. As shown in FIG. 27B, for instance, the masked IL-2 polypeptide constructs AK111 and AK168 did not result in a detectable number of mononuclear cells in the lung, unlike the non-masked constructs AK081 and AK167.

Infiltrating Immune Cell Phenotype

The phenotype of immune cells infiltrating tumors in vivo in mouse models treated with the masked IL-2 polypeptide constructs generated in Example 1 is assessed. Mice are treated with the constructs and the phenotype of tumor-infiltrating immune cells is assessed. In some experiments, some mice are treated with controls for comparison. In some experiments, some mice are treated with aldesleukin as a control for masked IL-2 polypeptide treatment. Mice bearing tumors are treated with a construct, aldesleukin, or another control, and tumors, tissues such as liver, lung, and spleen, and blood, are collected at various time points following the initial dose, such as five days, seven days, or ten days after the initial dose. In some experiments, immune cells are isolated from the tumors, tissues, and blood, and are subject to phenotypic assessment using flow cytometry. In some experiments, the isolated immune cells are assessed using markers of interest, such as those for CD8+ T cells, Memory CD8+ T cells, activated NK cells, CD4+ T cells, and CD4+ Treg cells.

In some studies, the phenotype of immune cells infiltrating tumors in vivo was assessed using the following method. C57BL/6 female mice were purchased from Charles River Laboratories and were 8-10 weeks old at the start of study. MC38 tumor cells ($5 \times 10^5$ cells per mouse) were injected subcutaneously into the right flank of each mouse. Upon reaching ~100 mm³ sized tumors (day 0), the mice received a single 2 mg/kg intravenous dose of the construct of interest (e.g., a non-masked parental IL-2 polypeptide construct, a masked IL-2 polypeptide construct, or a non-cleavable masked IL-2 polypeptide construct) in PBS. On day 5, mice were euthanized by CO2 asphyxiation and tumors, livers, spleens and blood were harvested. Cell suspensions were prepared from spleens by mechanical disruption and and passing through a 40 µm cell strainer. The tumor tissues were enzymatically digested using Miltenyi Tumor Dissociation Kit reagents (Miltenyi cat #130-096-730) and the gentleMACS Dissociator (Miltenyi) was used for the mechanical dissociation steps. Red blood cells in the spleen and tumor cell suspensions and blood were lysed using ACK buffer (Gibco cat #A10492). The cell suspensions were stained with the following antibodies: CD45 (clone 30-F111, eBioscience), CD3 (clone 2C11, Biolegend), CD8 (clone 53-6.7, BD Biosciences), CD4 (clone RM-45, BD Biosciences), FOXP3 (MF-14, Biolegend), CD25 (3C7, Biolegend), CD44 (clone IM7, eBioscience), and NKp46 (29A1.4, eBioscience). Data acquisition was carried out on the MACSQuant Analyzer flow cytometer (Milenyi) and data were analyzed using the FlowJo.

Results from studies testing the in vivo responses of CD4, CD8, NK, and Treg percentages in spleen, blood, and tumor, as carried out as described above, using the AK032, AK081, AK111, AK167, and AK168 constructs, as well as an anti-RSV IgG control, are shown in FIGS. 20A-20L. AK111 and AK168 are exemplary masked IL-2 polypeptide constructs.

Results from studies testing the in vivo responses of CD4, CD8, NK, and Treg percentages in spleen, blood, and tumor, as carried out as described above, using the AK167, AK168, AK191, AK197, AK203, AK209, and AK211 constructs, as well as an anti-RSV IgG control, are shown in FIGS. 21A-21L. AK168, AK191, AK197, AK203, and AK209 are exemplary masked IL-2 polypeptide constructs that each include a different cleavable peptide sequence in the linker connecting the IL-2 polypeptide to the half-life extension moiety. Statistical analysis was performed using One-way ANOVA as compared to the non-cleavable AK211 construct.

Results from studies testing the in vivo responses of CD4, CD8, NK, and Treg percentages in spleen, blood, and tumor, as carried out as described above, using the AK235, AK191, AK192, AK193, AK210, AK189, AK190, and AK211 constructs are shown in FIGS. 22A-22L. AK191, AK192, AK193, AK210, AK189, and AK190 are exemplary masked IL-2 polypeptide constructs that each include a cleavable peptide sequence in the linker connecting the IL-2 polypeptide to the half-life extension moiety. The linker sequence also differs among these constructs, depending on the linker sequence utilized. AK189, AK190, and AK210 include an IL-2 polypeptide having a C125A mutation, and AK191, AK192, and AK193 include an IL-2 polypeptide having C125A, R38A, F42A, Y45A, and E62A mutations. The AK235 construct is a non-masked construct and the AK211 construct includes a non-cleavable linker sequence. Statistical analysis was performed using One-way ANOVA as compared to the non-cleavable AK211 construct.

Results from studies testing the in vivo T cell activation in spleen, blood, and tumor, as carried out as described above, using the AK235, AK191, AK192, AK193, AK210, AK189, AK190, and AK211 constructs, as described above, are shown in FIGS. 23A-23I. T cell activation was measured as the mean fluorescence intensity (MFI) of CD25 in CD8+ T cells, CD4+ T cells, or Foxp3+ cells in the spleen, blood, and tumor. Statistical analysis was performed using One-way ANOVA as compared to the non-cleavable AK211 construct.

In Vivo Cleavage

The in vivo cleavage of masked IL-2 cytokine constructs is assessed. In some studies, a control antibody is administered for comparison. In some studies, in vivo cleavage is assessed by administering the construct of interest in a mouse and, after a certain period of time, capturing human IgG and then measuring the levels of, e.g., human IgG, CD122, and IL-2.

Figure 24E:
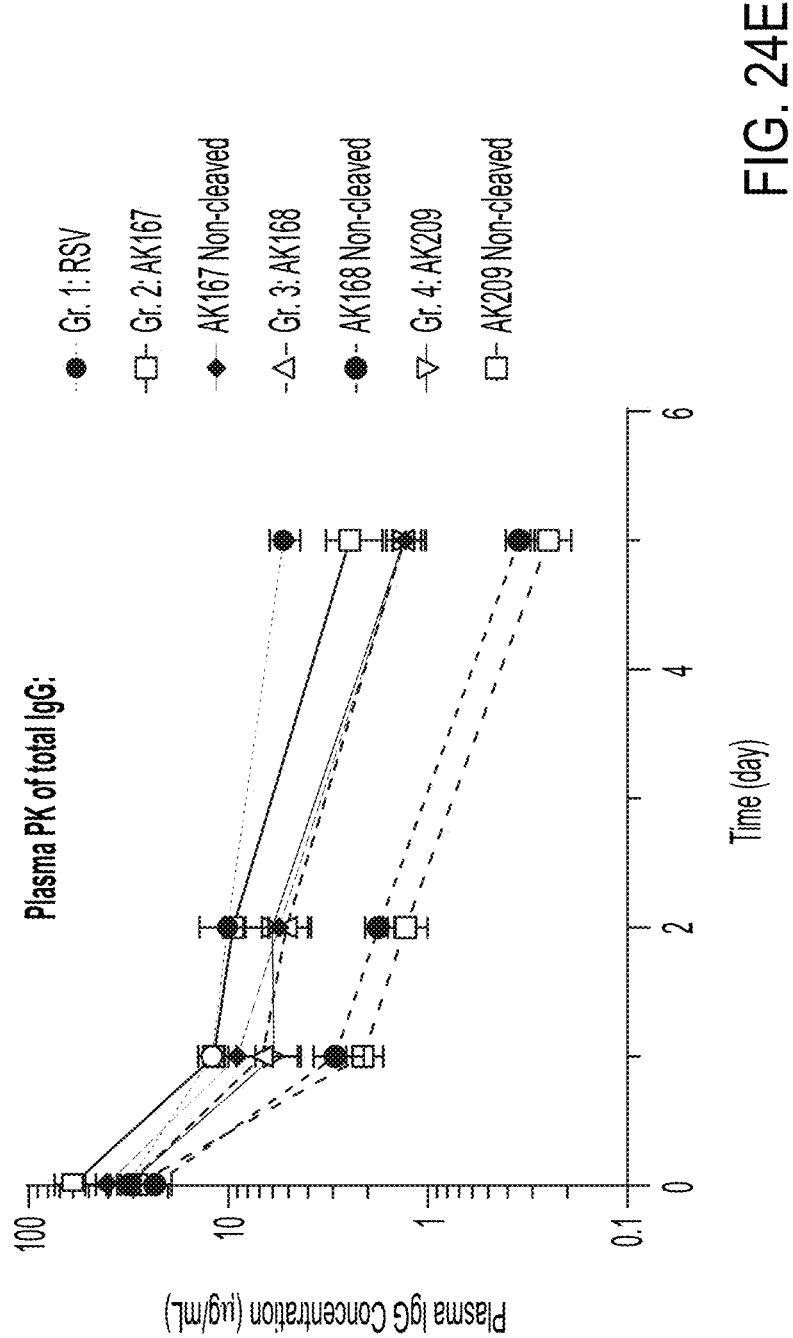
FIG. 24E shows results from a pharmacokinetic study of total plasma IgG concentration (μg/mL) for total levels of the AK167, AK168, and AK209 constructs, and for levels of non-cleaved forms of each construct.

In some studies testing the in vivo cleavage of masked IL-2 polypeptide constructs, drug levels (i.e., levels of the administered construct, including cleavage byproducts) were determined using ELISAs utilizing anti-human IgG (clone M1310G05, Biolegend) as the capture antibody and various detection antibodies. HRP or biotin conjugated detection antibodies against human IgG (ab97225, Abcam) or CD122 (clone 9A2, Ancell) and IL-2 (Poly5176, Biolegend) were utilized to detect total and non-cleaved drug levels, respectively. The concentrations of cleaved and released IL-2 is calculated by subtracting non-cleaved (i.e., intact) from total drug concentrations. FIGS. 24A-24D depict the results from studies testing the in vivo cleavage of the exemplary masked IL-2 polypeptide constructs AK168 (cleavable peptide sequence: MPYDLYHP; SEQ ID NO: 24) and AK209 (cleavable peptide sequence: VPLSLY; SEQ ID NO: 28). The AK167 construct is a cleavable non-masked IL-2 polypeptide construct that includes the same IL-2 polypeptide as the masked AK168 construct. As shown in FIGS. 24A-24D, both the masked (AK168 and AK209) and non-masked (AK167) constructs were effectively cleaved, and both cleavable peptide sequences were cleaved. FIG. 24E depicts results from a pharmacokinetic study of total plasma IgG concentration (μg/mL) for total levels of the AK167, AK168, and AK209 constructs, and for levels of non-cleaved forms of each construct.

Tumor Eradication and Inhibition of Metastasis

The ability of the masked IL-2 polypeptide constructs generated in Example 1 to promote tumor eradication and to inhibit metastasis is assessed in vivo using mouse models, such as syngeneic MC38, CT26, and B16F10 tumor models.

Mice are implanted with tumor cells subcutaneously, and tumors are allowed to grow to a palpable size. Tumor-bearing mice are treated with the masked IL-2 constructs or the masked IL-15 polypeptide constructs and tumor volume is measured over the course of treatment. In some experiments, some mice are treated with controls for comparison. In some experiments, some mice are treated with aldesleukin as a control for masked IL-2 polypeptide treatment. Tumor volume is measured periodically over the course of treatment. In some experiments, body weight is also measured periodically over the course of treatment. In some experiments, plasma samples are produced over the course of the treatment and analyzed for pharmacokinetics, pharmacodynamics, cleavage, and blood markers, such as those for $CD8^+$ T cells, Memory $CD8^+$ T cells, activated NK cells, $CD4^+$ T cells, and $CD4^+$ Treg cells.

The capability of the masked IL-2 polypeptide constructs to inhibit metastasis is also assessed in vivo using mouse models suitable for metastasis studies, such as syngeneic CT26 tumor models for assessing lung metastasis. Mice are implanted with tumor cells subcutaneously. In some experiments, tumors are allowed to grow to a palpable size prior to treatment. In some experiments, treatment begins before tumors grow to palpable size. Tumor-bearing mice are treated with the masked IL-2 constructs are assessed for tumor cell metastasis into tissues such as lungs, liver, and lymph nodes.

Figure 28A:
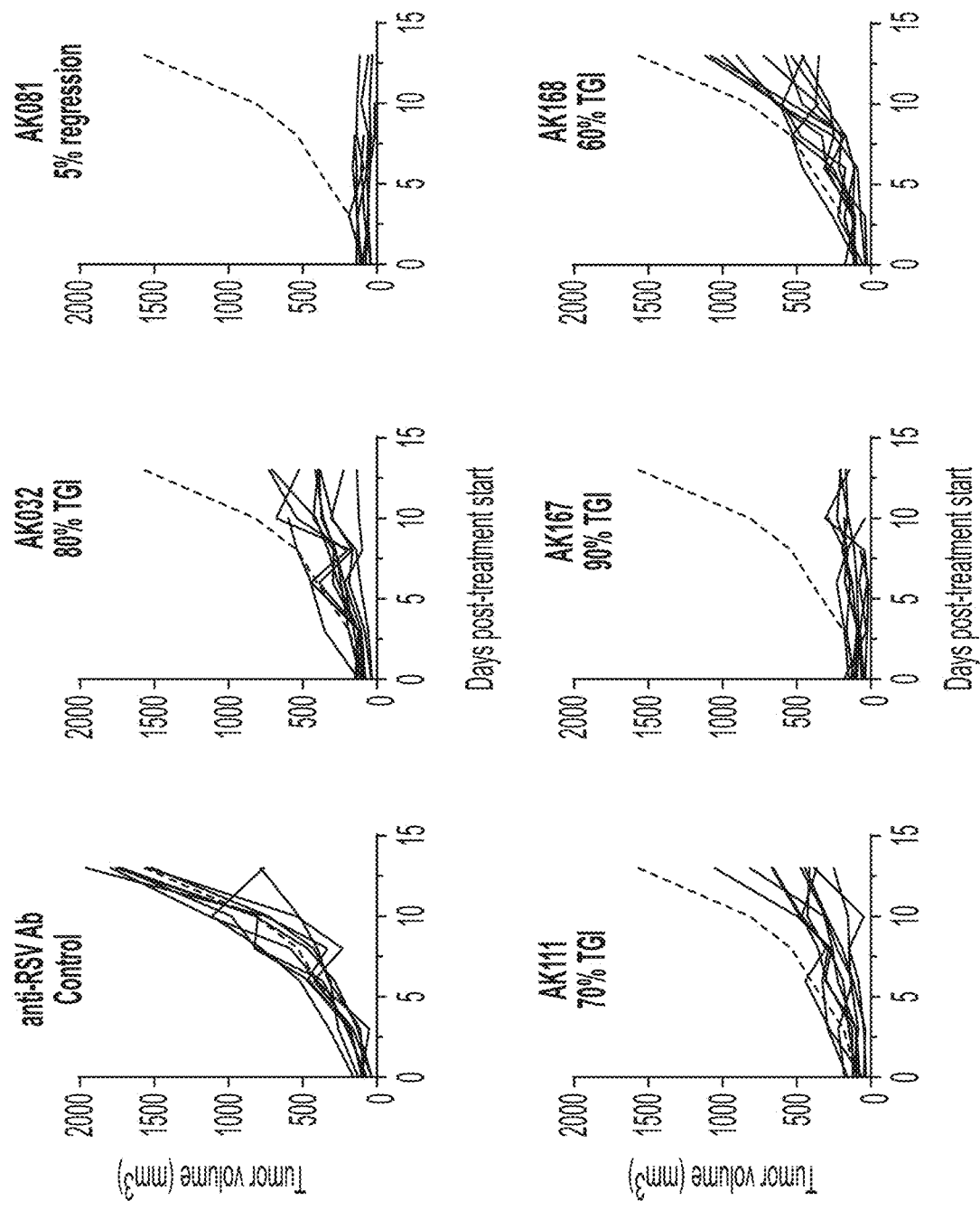
FIGS. 28A and 28B show results from a syngeneic tumor model study that assessed tumor volume and body weight over the course of treatment with the AK032, AK081, AK111, AK167, or AK168 construct, or an anti-RSV control.
Figure 28B:
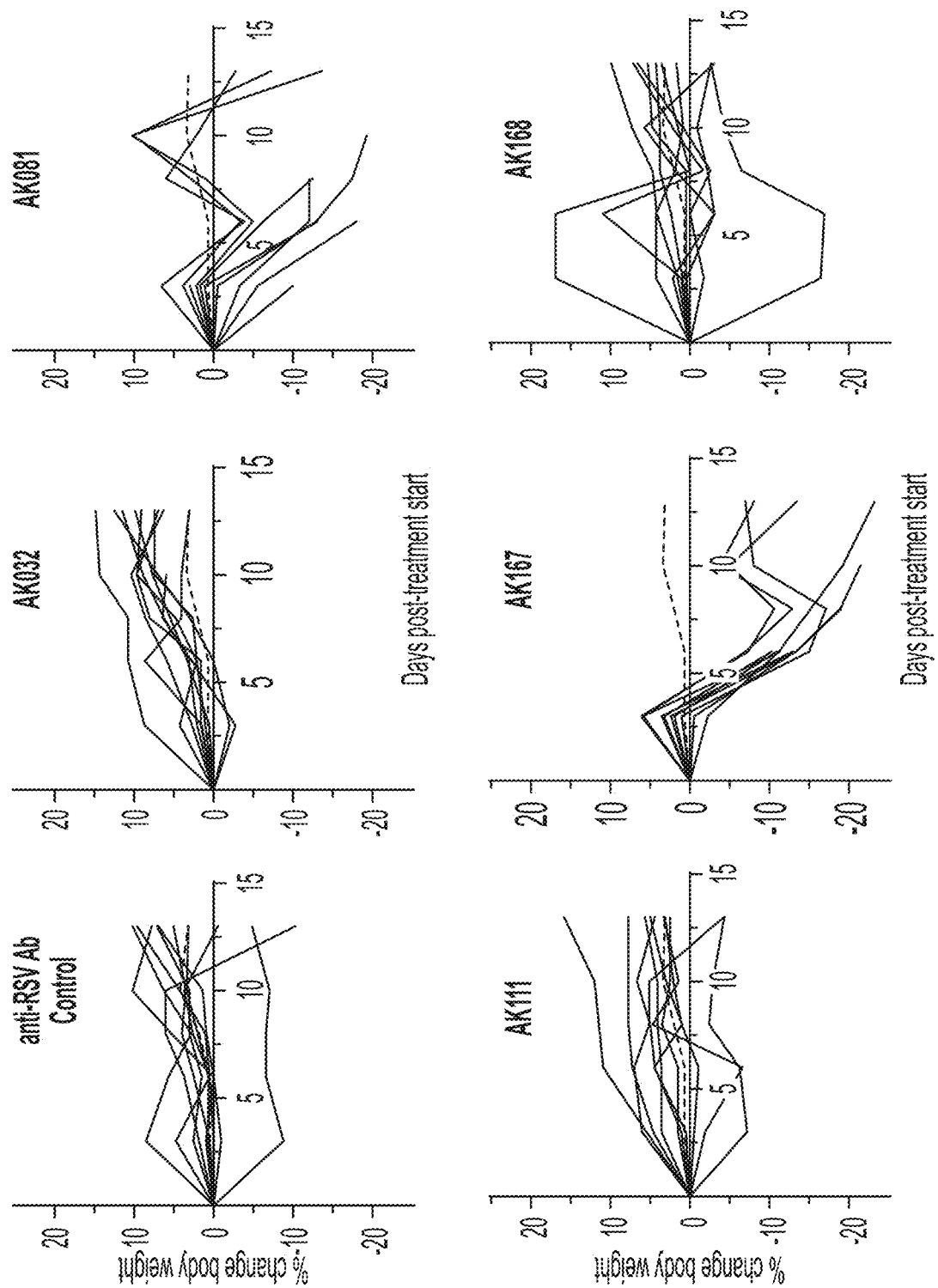

In some studies, a syngeneic tumor model was used to assess the ability of masked IL-2 polypeptide constructs to reduce tumor volume in accordance with the following method. C57BL/6 female mice were purchased from Charles River Laboratories and were 8-10 weeks old at the start of study. MC38 tumor cells (5×105 cells per mouse) were injected subcutaneously into the right flank of each mouse. Upon reaching ~125 mm3 sized tumors (day 0), the mice were randomized to receive 2 mg/kg doses of AK081, AK111, AK167, or AK168, or an anti-RSV antibody as a control, in PBS. Mice were dosed intraperitoneally, three times a week for 6 doses. Tumor volume was calculated (Length*(Width^2)/2) using dial calipers and body weights were recorded twice weekly. FIGS. 28A and 28B show results from a syngeneic tumor model study that assessed tumor volume and body weight over the course of treatment. As shown in FIG. 28A, treatment using exemplary IL-2 polypeptide constructs, including the masked constructs AK111 and AK168, resulted in tumor growth inhibition over time as compared to the anti-RSV control. As shown in FIG. 28B, there was a general lack of body weight reduction observed when the mice were treated with the masked constructs AK1111 and AK168.

Bioactivity in Cynomolgus Monkeys

The in vivo bioactivity of the masked IL-2 polypeptide constructs generated in Example 1 is assessed in vivo in cynomolgus monkeys. Cynomolgus monkeys are treated with the constructs and in vivo bioactivity, pharmacokinetics, and cleavage is assessed. In some experiments, some monkeys are treated with controls for comparison. In some experiments, some monkeys are treated with aldesleukin as a control for masked IL-2 polypeptide treatment. In some experiments, the monkeys are treated with various doses of the construct, aldesluekin, or other control. Blood is collected from the monkeys at various time points and is then evaluated for certain cell types, such as CD8+ T cells, Memory CD8+ T cells, activated NK cells, CD4+ T cells, and CD4+ Treg cells, and/or markers of interest, such as for the dose-response of total lymphocytes, Ki67+, and of soluble CD25. In some experiments, the longitudinal kinetics of the proliferation and expansion of certain circulating T and NK cell types is assessed. In some experiments, pharmacokinetics and cleavage of the masked IL-2 polypeptide constructs are determined by ELISA, PAGE, and mass spectrometry.

To test the safety profile of exemplary masked IL-2 polypeptide constructs in non-human primates, a dose ranging study is performed in accordance with the following method. Groups of 3 healthy male cynomolgus monkeys (*Macaca fascicularis*) are randomly assigned to receive a single intravenous bolus dose of 2 mL/kg of activatable (i.e., cleavable) masked IL-2 polypeptide proteins or non-cleavable masked IL-2 polypeptide proteins at 10, 30 and 100 nmol/kg in 100 mM sodium citrate buffer (pH 5.5). A third group receives the parental non-masked, cleavable protein at 3, 10 and 30 nmol/kg as a positive control. This third group is dosed at a lower range to account for higher potency of the parental non-masked molecules. Doses are calculated in moles to account for differences in molecular weight. Blood samples are collected before dosing and 1, 24, 48, 72, 96, 168, 264 and 336 hours post-dosing. An automated hematology analyzer is used to monitor changes in lymphocyte subsets and serum chemistry. Total and intact (i.e., non-cleaved) drug levels are measured from plasma using custom ELISA as described above. Soluble CD25 levels are measured with an ELISA (R&D systems, cat #DR2A00) to monitor immune stimulation. Plasma levels of inflammatory cytokines are quantified using custom multiplexed electrochemiluminescence assay (Meso Scale Discovery). Blood pressure is monitored as an indicator of vascular leak syndrome. PK is analyzed using an ELISA that captures IL-2 and detects human Fc and by an ELISA that captures human Fc and detects human Fc.

Example 4

C57BL/6 female mice were purchased from Charles River Laboratories and were 8-10 weeks old at the start of study. MC38 tumor cells (5×10$^5$ cells per mouse) were injected subcutaneously into the right flank of each mouse. Upon reaching ~100 mm sized tumors (day 0), the mice received a single high dose intraperitoneal dose of various Fc-IL-2 constructs in PBS. Plasma were collected at 5 min, days 3, 5 and 7 after dosing.

The constructs used are shown in FIG. 68:

Immunophenotyping was performed using a FACS-based method. On day 5, mice were euthanized by CO2 asphyxiation and tumors, livers, spleens and blood were harvested. Cell suspensions were prepared from spleens by mechanical disruption and passing through a 40 m cell strainer. The tumor tissues were enzymatically digested using Miltenyi Tumor Dissociation Kit reagents (Miltenyi cat #130-096-730) and the gentleMACS Dissociator (Miltenyi) was used for the mechanical dissociation steps. Red blood cells in the spleen and tumor cell suspensions and blood were lysed using ACK buffer (Gibco cat #A10492).

The cell suspensions were stained with the following antibodies: CD45 (clone 30-F11, eBioscience), CD3 (clone 2C11, Biolegend), CD8 (clone 53-6.7, BD Biosciences), CD4 (clone RM-45, BD Biosciences). Data acquisition was carried out on the MACSQuant Analyzer flow cytometer (Milenyi) and data were analyzed using the FlowJo.

Drug levels were determined using ELISAs utilizing anti-human IgG (clone M1310G05, Biolegend) as the capture antibody and various detection antibodies. HRP or biotin conjugated detection antibodies against human IgG (ab97225, Abcam) or CD122 (clone 9A2, Ancell) and IL-2 (Poly5176, Biolegend) were utilized to detect total and non-cleaved drug levels, respectively.

Figure 29A:
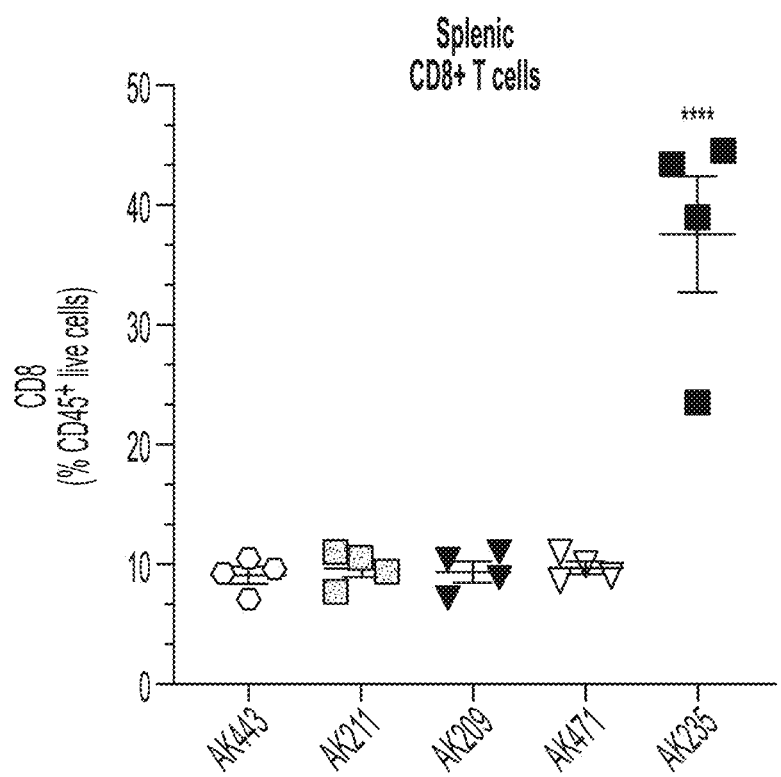
FIGS. 29A and 29B show AK471 with I253A FcRn mutation induced robust CD8 T cells expansion in the TME while remaining inactive in the periphery.
Figure 29B:
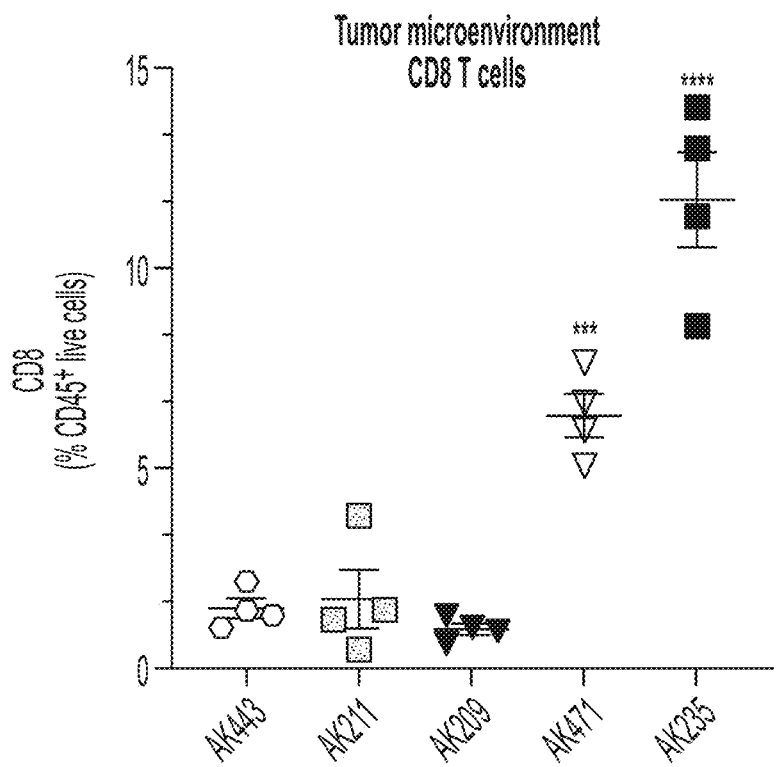

AK471 with I253A FcRn mutation induced robust CD8 T cells expansion in the TME while remaining inactive in the periphery as shown in FIGS. 29A and 29B.

Figure 30A:
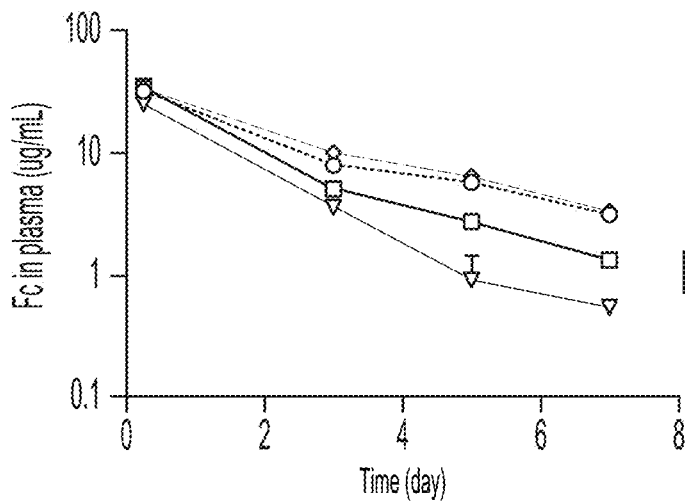
FIG. 30A shows level of Fc in plasma over time.
Figure 30B:
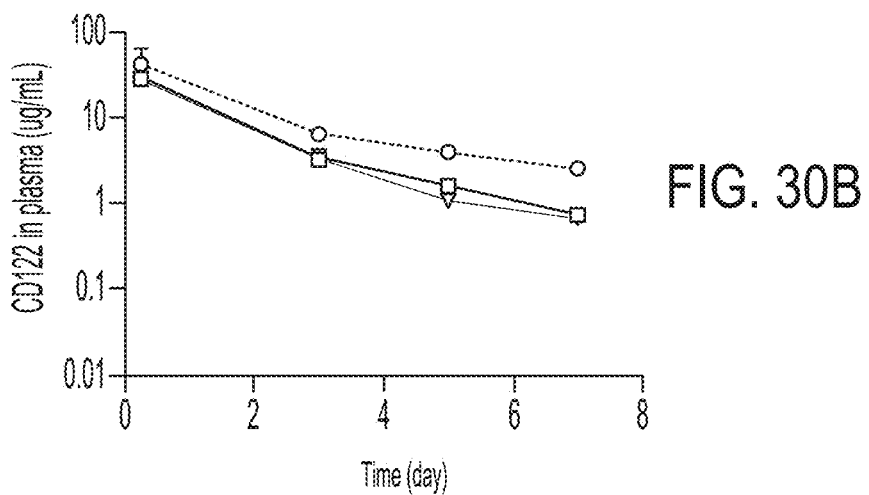
FIG. 30B shows level of CD122 in plasma over time.
Figure 30C:
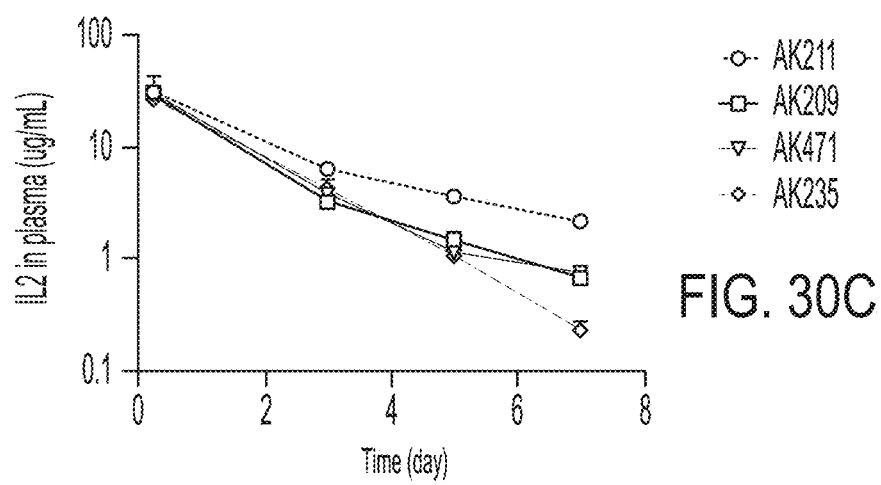
FIG. 30C shows level of IL2 in plasma over time.
Figure 31A:
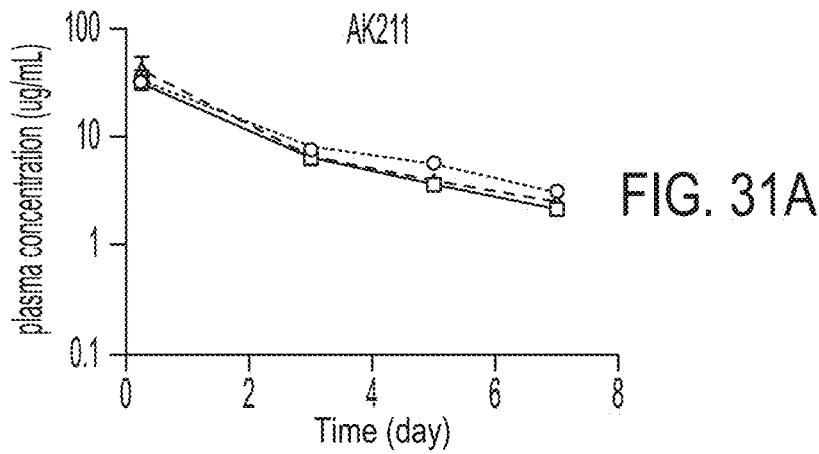
FIG. 31A shows plasma concentration over time for construct AK211.
Figure 31B:
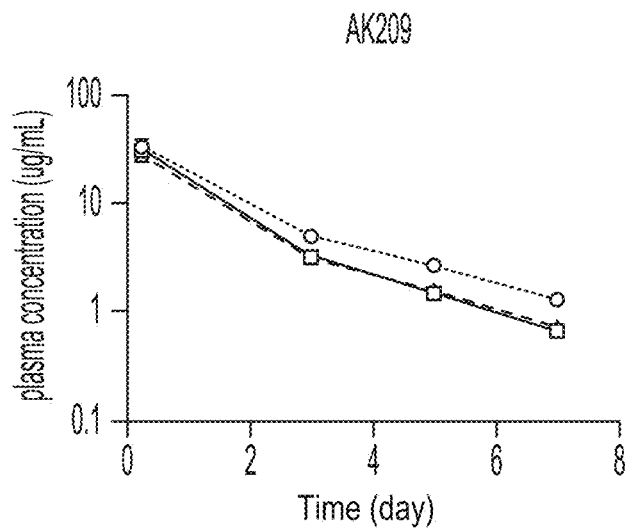
FIG. 31B shows plasma concentration over time for construct AK209.
Figure 31C:
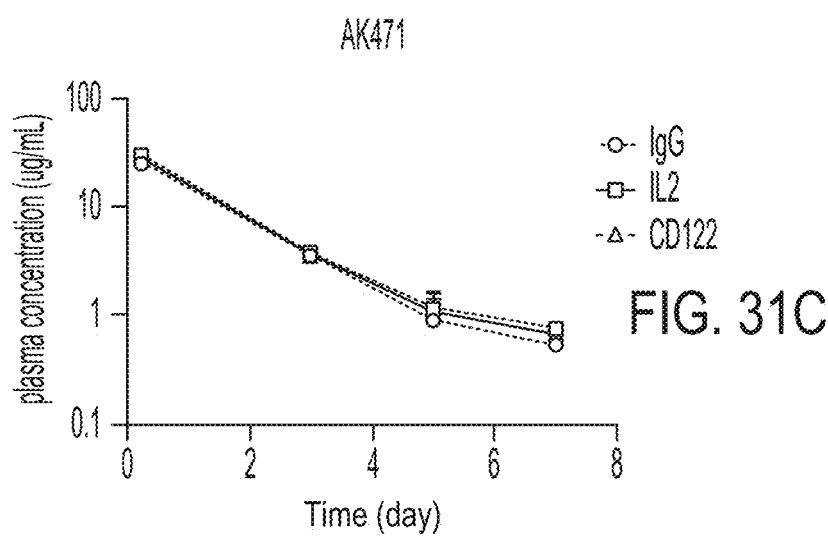
FIG. 31C shows plasma concentration over time for construct AK471.

AK471 has slightly shorter half-life compared to aglyco-hIgG1 as shown in FIG. 30 A, B and C. There is no evidence of cleavage or decapitation with AK471 in the plasma (FIG. 31 A, B and C).

Example 5

Summary of Cys to Ser Mutations on CD122

The two free cysteines on the CD122 masking domain were mutated to serines to increase protein stability and mitigate developability risks including, without being limited as to theory, aggregation, oxidation, and immunogenicity. The mutant was evaluated in an accelerated stability study, where the control and the Cys to Ser mutant was incubated for a prolonged time (3 weeks), with elevated temperature (40° C.), and in multiple pHs. Various analyses were performed to assess the impact of the cysteine mutations. The results demonstrate that the Cys to Ser mutant clearly enhanced the protein stability as evidenced by significantly reduced aggregation under stress. After 3 weeks incubation at pH8.0, the constructs with the cysteines mutated exhibit low levels of aggregation as compared to the control constructs, which do not contain the cysteine mutations, that have greater than fifty (50) percent aggregation as measured by SEC-HPLC. CE-SDS demonstrated that the construct with the mutated cysteines remains unaggregated (>99%) for pH6.0 and pH8.0 incubation, where the control constructs contained levels of aggregation up to fifteen (15) percent 1.

In addition, constructs with the mutated cysteines in the CD122 masking protein interact with the IL-2 protein in a similar manner as the control constructs, which contain a wild-type CD122 masking protein (i.e. without mutation of the cysteine residues). In addition, the constructs with the mutated cysteines in the CD122 masking protein are similar in both functional assays and pharmacodynamics studies as the control constructs, which contain a CD122 masking protein without the cysteine mutations.

Experimental Protocols

Stability Study

Samples were incubated in a Galaxy 170 S air incubator set to 40° C. Three buffer systems were tested: 20 mM Citrate pH 5.0, 20 mM histidine pH 6.0, and 20 mM tris pH 8.0. The pH of each was calibrated at room temperature (approximately 27C) and buffers were adjusted to within 0.05 pH units with HCl/NaOH. Buffers were filtered by 0.22 um bottle top filters. Samples were buffer exchanged approximately 3000-fold into starting buffer via spin concentration. Sample aliquots were removed under sterile conditions at day 0, 1, 3, 7, 14, and 21, and stored at −80° C. before being evaluated in the below analytical tests.

SEC-HPLC

An HPLC system was used to assess the aggregation level in the incubated samples; the system was calibrated with along with molecular weight standards. Levels of high molecular weight species ("HMWS") were measured in each sample. Increases in HMWS indicated increasing levels of aggregation.

Figure 32A:
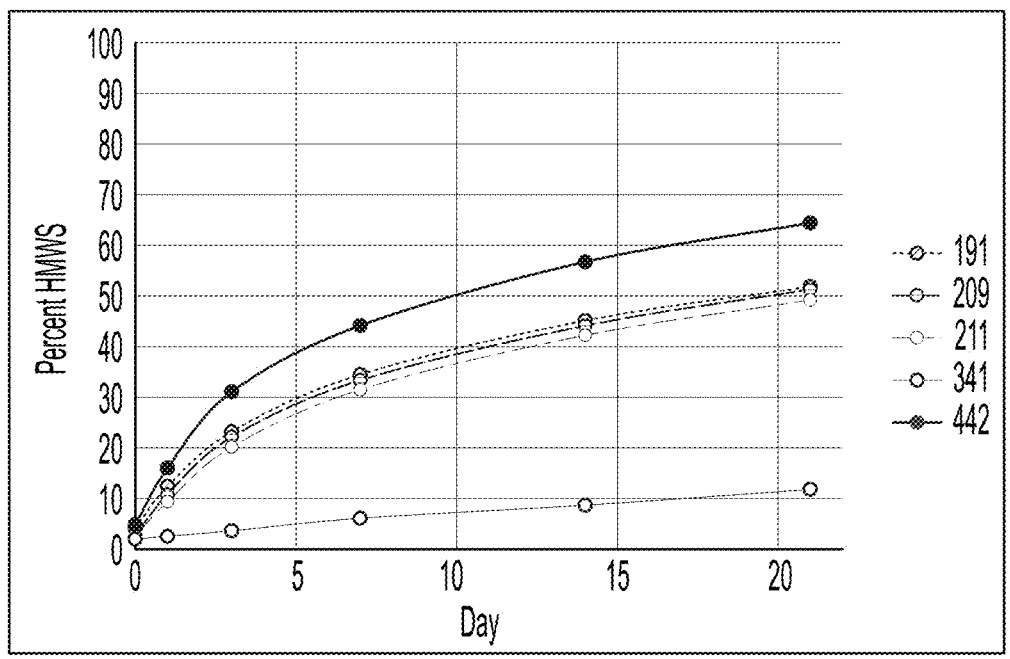
FIGS. 32A and 32B show effects on the stability of the constructs upon Cys to Ser mutations measured in terms of percentage of HMWS by SEC-HPLC.
Figure 32B:
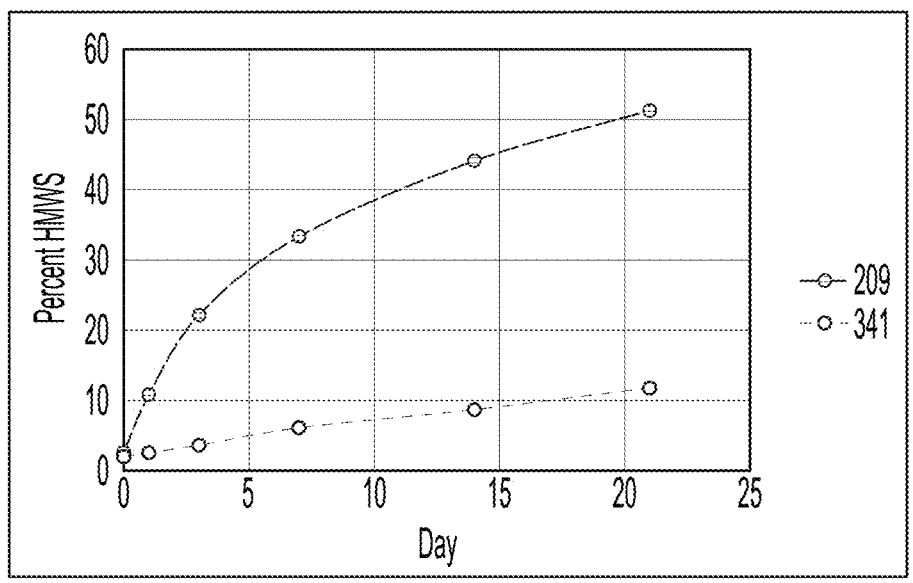
Figure 33A:
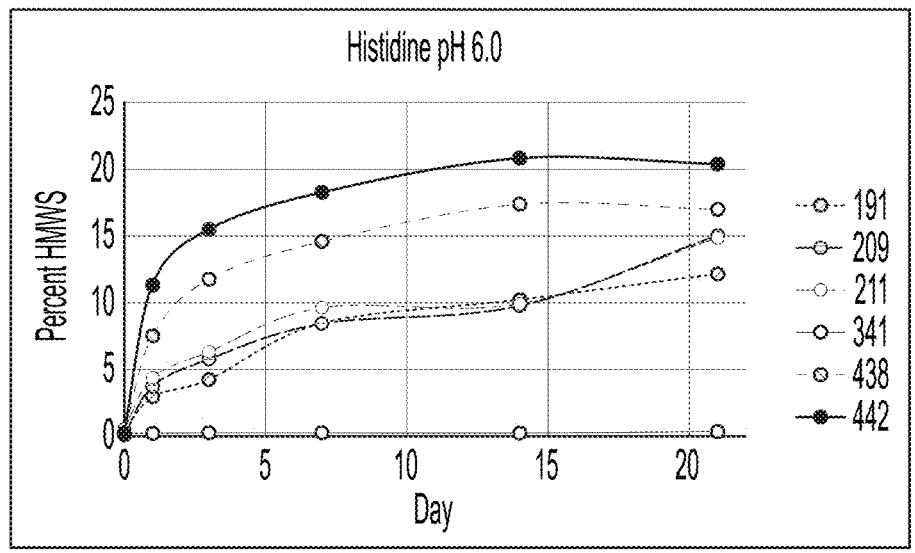
FIGS. 33A-33D show effects on the stability of the constructs upon Cys to Ser mutations measured in terms of percentage of HMWS by CE-SDS.
Figure 33B:
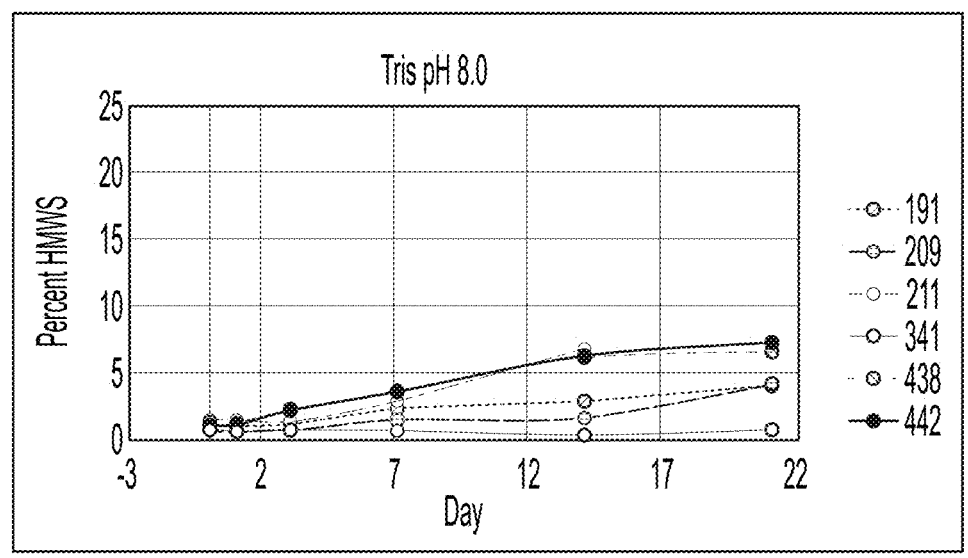
Figure 33C:
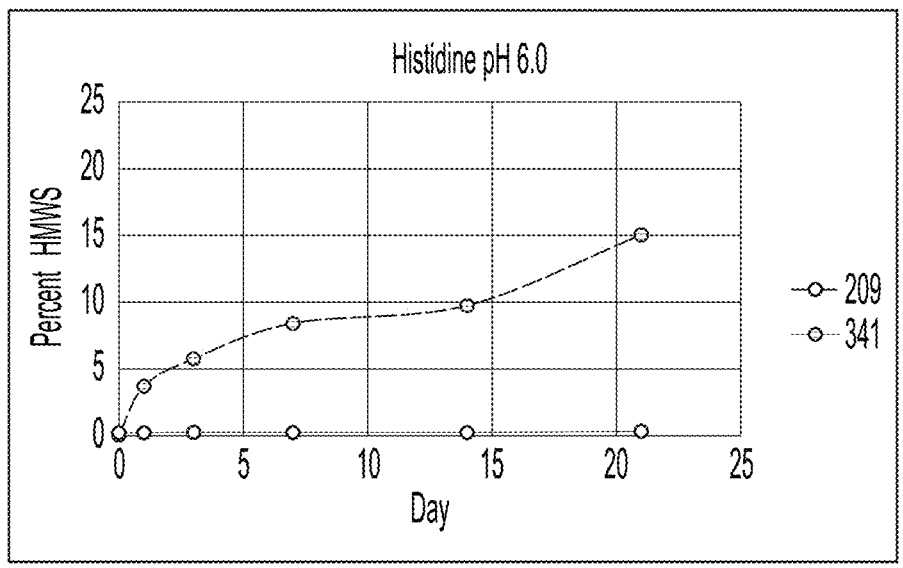
Figure 33D:
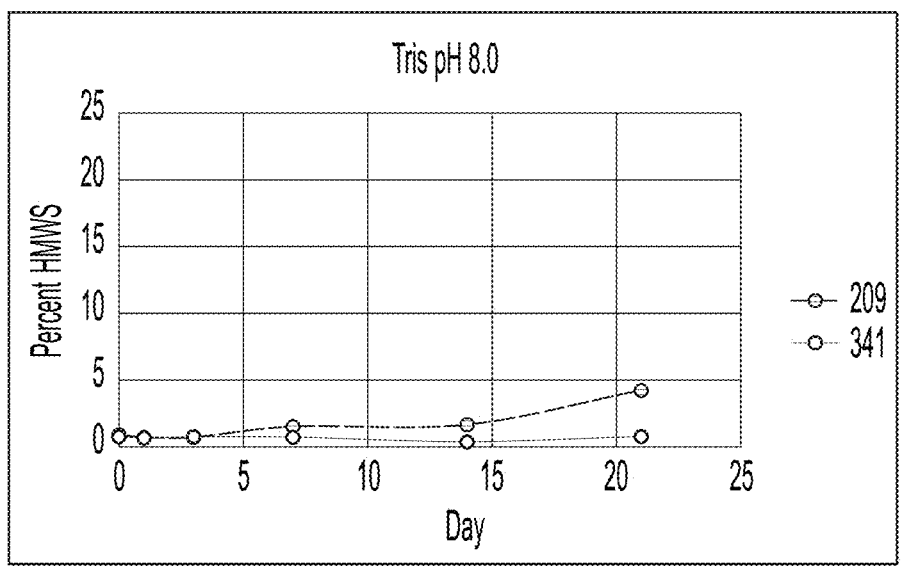

The results of these studies is shown in FIGS. 32A and 32B. The key represents 'AK' molecule numbers, where AK341 is a Cys to Ser mutant and AK209 is a control.

CE-SDS

CE-SDS was run on a labchip machine. In general, a reducing agent was used for experiments under reducing conditions. Samples were subjected to high heat before samples were loaded into 96-well PCR plate. Recombinant human IL-2 was used as a low molecular weight protein control. Levels of HMWS were measured in each sample. Increases in HMWS indicated increasing levels of aggregation.

The results of these studies is shown in FIGS. 33A-33D. The key represents 'AK' molecule numbers, where AK341 is a Cys to Ser mutant and AK209 is a control.

Example 6

The constructs used are as follows:

| AK# | Protease substrate | Protease site on | Half-life extension |
|---|---|---|---|
| AK209 | VPLSLY | IL-2 | Agly-hIgG1 |
| AK341* | VPLSLY | IL-2 | Agly-hIgG1 |
| AK438 | VPLSLY | CD 122 | Agly-hIgG1 |
| AK471 | VPLSLY | IL-2 | FcRn-I253A |
| AK505 | VPLSLY | CD 122 | FeRn-I253A |
| AKS04 | VPLSLY | IL-2 | FcRn-hIgG4 |
| AK511 | VPLSLY | CD 122 | FcRn-hIgG4 |
| AK203 | DSGGFMLT | IL-2 | Agly-hIgG1 |
| AK442 | DSGGPVTT | CD 122 | Agly-hIgG1 |
| AK168 | MPYDLYHP | IL-2 | Agly-hIgG1 |
| AK252 | MPYDLYHP | CD 122 | Agly-hIgG1 |
| AK509 | MPYDLYHP | IL-2 | FcRn-I253A |
| AK510 | MPYDLYHP | CD122 | FcRn-I253A |

| AK# | Protease substrate | Protease site on | Half-life extension |
|---|---|---|---|
| AK191 | RAAAVKSP | IL-2 | Agly-hIgG1 |
| AK503 | RAAAVKSP | CD122 | Agly-hIgG1 |

AK211 - Non-cleavable
AK253 - parental (no mask);
no cleavage site; always active AK341* contains two cys -> ser mutations on CD122.

i. Anti-Tumor Activity—AK438 and AK442

C57BL/6 female mice were purchased from Charles River Laboratories and were 8-10 weeks old at the start of study. MC38 tumor cells (5×105 cells per mouse) were injected subcutaneously into the right flank of each mouse. Upon reaching ~100 mm3 sized tumors (day 0), the mice were randomized to receive Fc-IL-2 constructs in PBS. Mice were dosed intravenously on days 0, 3 and 6. Tumor volume was calculated (Length*(Width^2)/2) using dial calipers and body weights were recorded twice weekly. Mice were sacrificed upon reaching humane end points of tumor burden (2000 mm3) or body weight loss due to toxicity (20%).

Figure 34A:
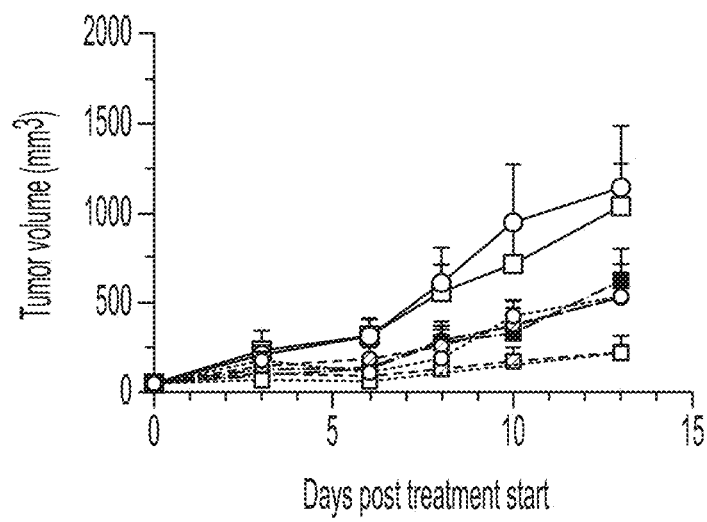
FIG. 34A shows tumor volume over time.
Figure 34B:
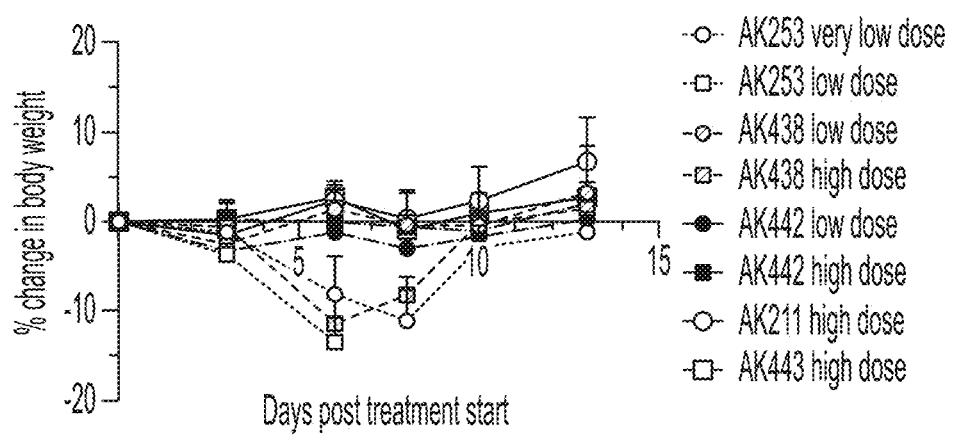
FIG. 34B shows change in body weight over time.

Results are shown in FIGS. 34A and B.

ii. Peripheral (Spleen) Vs Tumor CD8 T Cell Expansion—AK438 and AK442

C57BL/6 female mice were purchased from Charles River Laboratories and were 8-10 weeks old at the start of study. MC38 tumor cells (5×10$^5$ cells per mouse) were injected subcutaneously into the right flank of each mouse. Upon reaching ~100 mm$^3$ sized tumors (day 0), the mice were randomized to receive AK253 at very low dose level and all other Fc-IL-2 constructs at high dose level in PBS. Mice were dosed intravenously on days 0, 3 and 6.

Figure 35A:
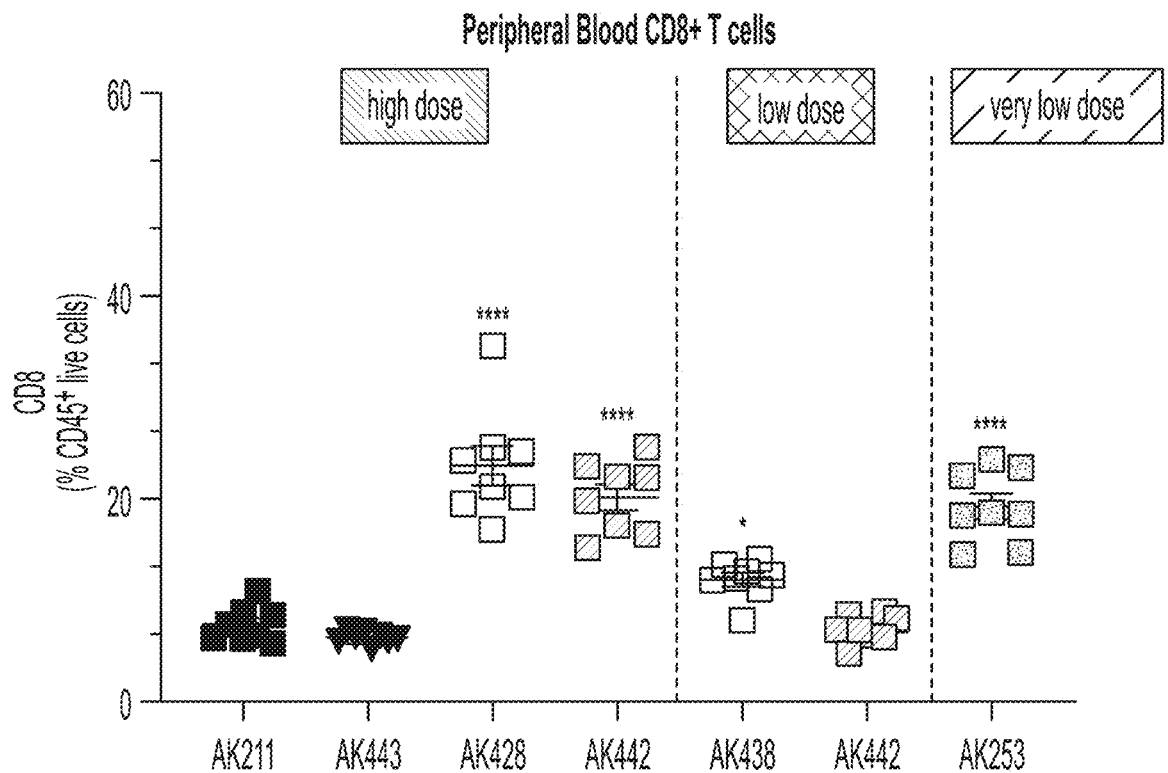
FIG. 35A shows percentage CD45$^+$ live cells for different constructs at high dose, low dose, and very low dose.
Figure 35B:
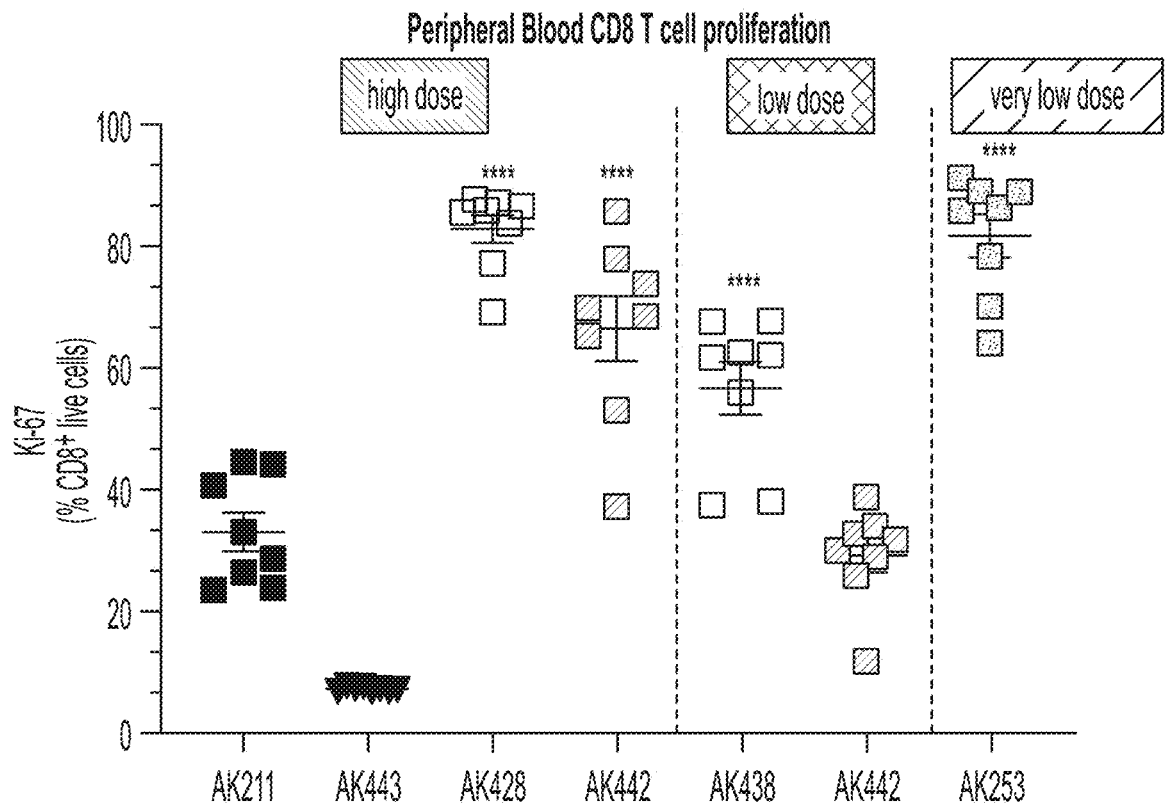
FIG. 35B shows percentage CD8$^+$ live cells for different constructs at high dose, low dose, and very low dose.

Immunophenotyping on day 7 was performed using a FACS-based method from peripheral blood. Red blood cells were lysed using ACK buffer (Gibco cat #A10492). The cell suspensions were stained with the following antibodies: CD45 (clone 30-F11, eBioscience), CD3 (clone 2C11, Biolegend), CD8 (clone 53-6.7, BD Biosciences), CD4 (clone RM-45, BD Biosciences) and Ki-67 (clone SOLA15, eBioscience). Data acquisition was carried out on the MACSQuant Analyzer flow cytometer (Milenyi) and data were analyzed using the FlowJo. A one-way ANOVA with Bonferonni's post-test was performed to determine the statistical significance of treatment vs. control AK211) (*P<0.05; P<0.01; *P<0.001; ****P<0.0001). Results are shown in FIGS. 35A and B.

iii. Anti-Tumor Activity—AK252, AK438, AK209 and AK471

C57BL/6 female mice were purchased from Charles River Laboratories and were 8-10 weeks old at the start of study. MC38 tumor cells (5×105 cells per mouse) were injected subcutaneously into the right flank of each mouse. Upon reaching ~100 mm3 sized tumors (day 0), the mice were randomized to receive AK253 at very low dose level and all other Fc-IL-2 constructs at high dose level in PBS. Mice were dosed intravenously on days 0, 3 and 6. Tumor volume was calculated (Length*(Width^2)/2) using dial calipers and body weights were recorded twice weekly. Mice were sacrificed upon reaching humane end points of tumor burden (2000 mm3) or body weight loss due to toxicity (20%).

Figure 36A:
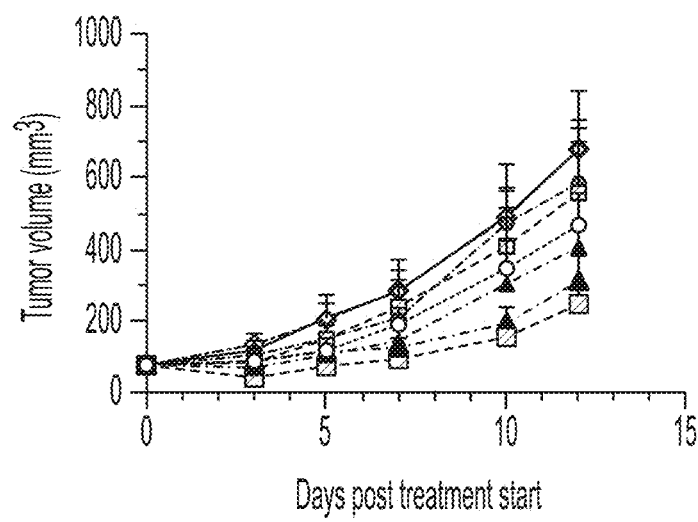
FIG. 36A shows tumor volume over time for different constructs and doses.
Figure 36B:
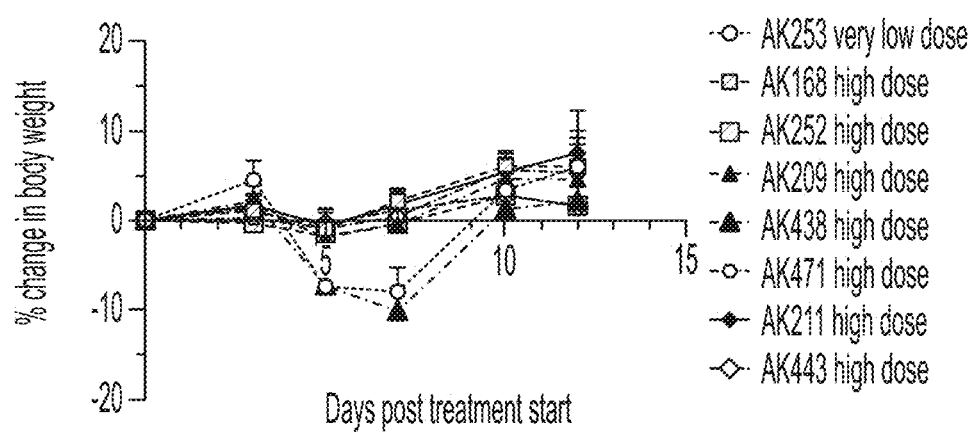
FIG. 36B shows change in body weight over time for different constructs and doses.

Results are shown in FIGS. 36A and 36B.

iv. Peripheral (Spleen) Vs Tumor CD8 T Cell Expansion—AK252, AK438, AK209, AK471

C57BL/6 female mice were purchased from Charles River Laboratories and were 8-10 weeks old at the start of study. MC38 tumor cells (5×105 cells per mouse) were injected subcutaneously into the right flank of each mouse. Upon reaching ~100 mm3 sized tumors (day 0), the mice were randomized to receive AK253 at very low dose level and all other Fc-IL-2 constructs at high dose level in PBS. Mice were dosed intravenously on days 0, 3 and 6.

Figure 37A:
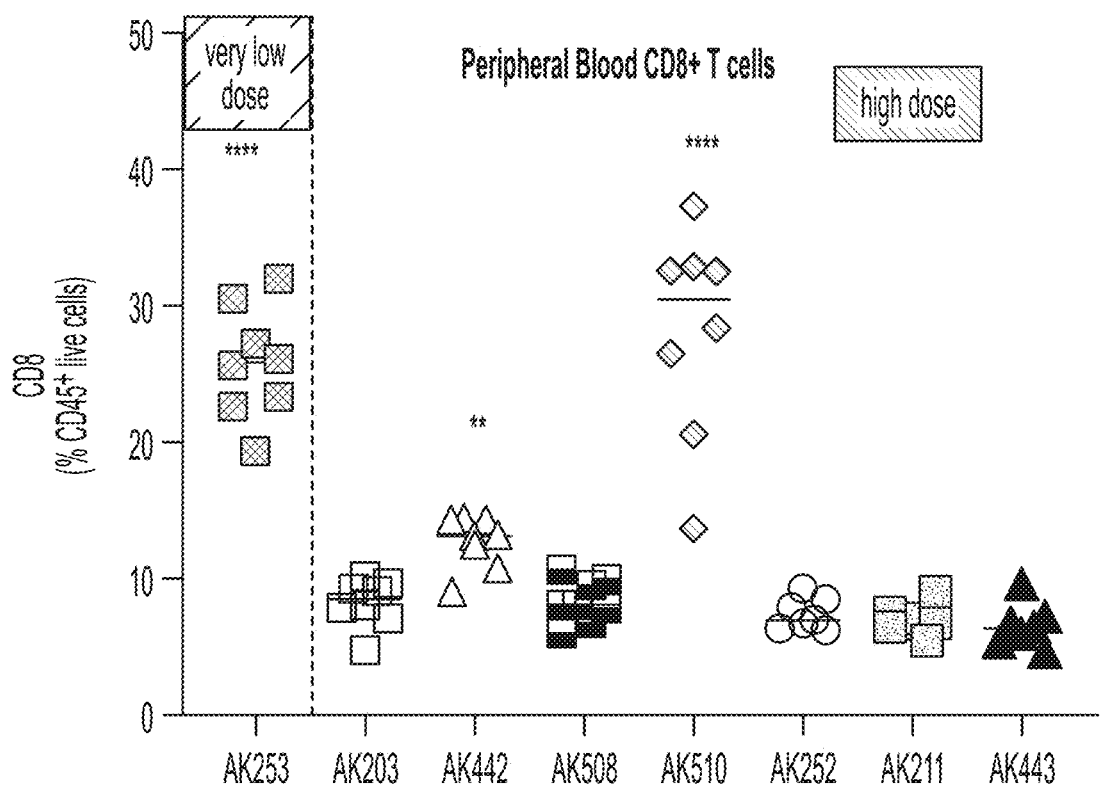
FIG. 37A shows percentage CD45$^+$ live cells for different constructs at high dose and very low dose.
Figure 37B:
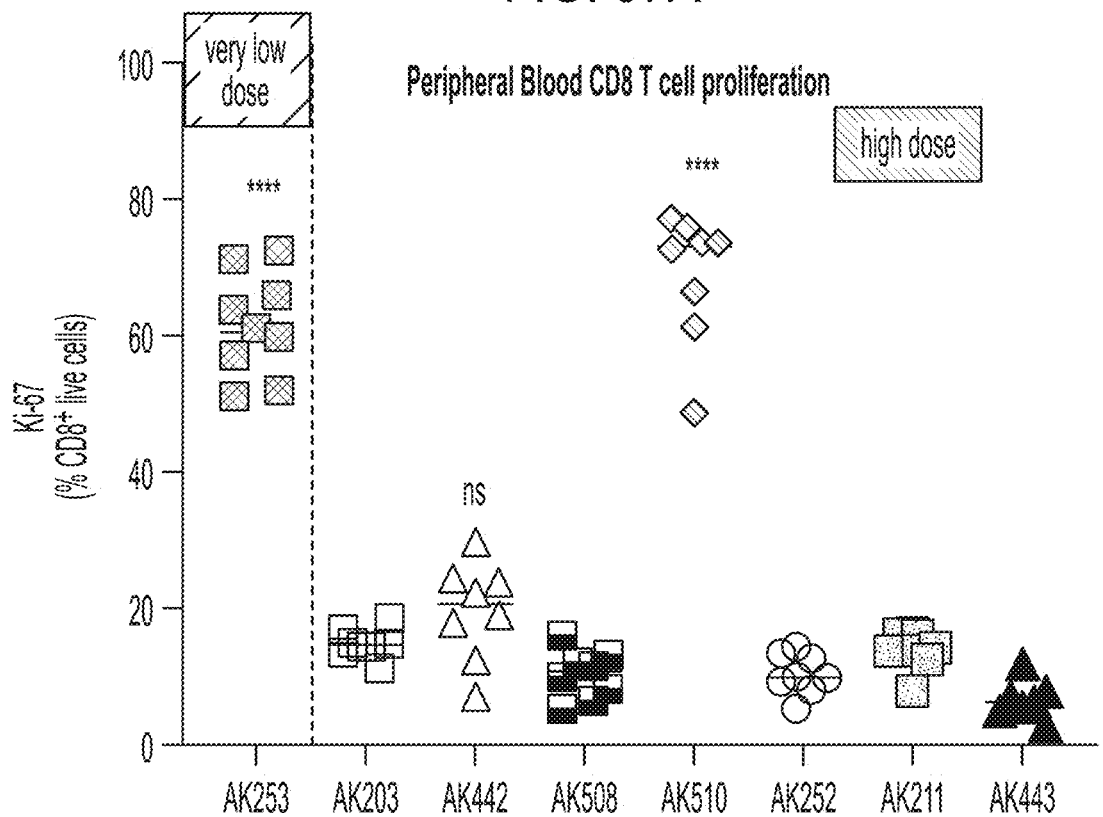
FIG. 37B shows percentage CD8$^+$ live cells for different constructs at high dose and very low dose.

Immunophenotyping on day 7 was performed using a FACS-based method from peripheral blood. Red blood cells were lysed using ACK buffer (Gibco cat #A10492). The cell suspensions were stained with the following antibodies: CD45 (clone 30-F11, eBioscience), CD3 (clone 2C11, Biolegend), CD8 (clone 53-6.7, BD Biosciences), CD4 (clone RM-45, BD Biosciences) and Ki-67 (clone SOLA15, eBioscience). Data acquisition was carried out on the MACSQuant Analyzer flow cytometer (Milenyi) and data were analyzed using the FlowJo. A one-way ANOVA with Bonferonni's post-test was performed to determine the statistical significance of treatment vs. control AK211) (*P<0.05; P<0.01; *P<0.001; ****P<0.0001). Results are shown in FIGS. 37A and 37B.

v. Anti-Tumor Activity—AK252, AK442, AK203, AK508 and AK510

C57BL/6 female mice were purchased from Charles River Laboratories and were 8-10 weeks old at the start of study. MC38 tumor cells (5×105 cells per mouse) were injected subcutaneously into the right flank of each mouse. Upon reaching ~100 mm3 sized tumors (day 0), the mice were randomized to receive AK253 at very low dose level and all other Fc-IL-2 constructs at high dose level in PBS. Mice were dosed intravenously on days 0, 3 and 6. Tumor volume was calculated (Length*(Width^2)/2) using dial calipers and body weights were recorded twice weekly. Mice were sacrificed upon reaching humane end points of tumor burden (2000 mm3) or body weight loss due to toxicity (20%).

Figure 38A:
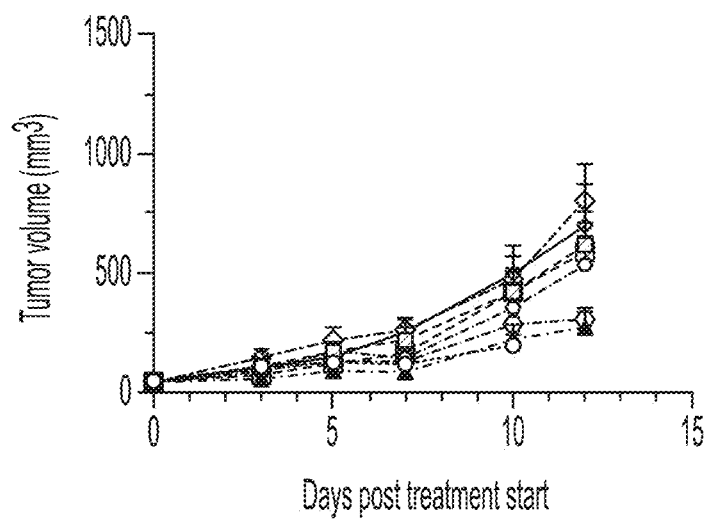
FIG. 38A shows tumor volume over time for different constructs and at very low dose and very high doses.
Figure 38B:
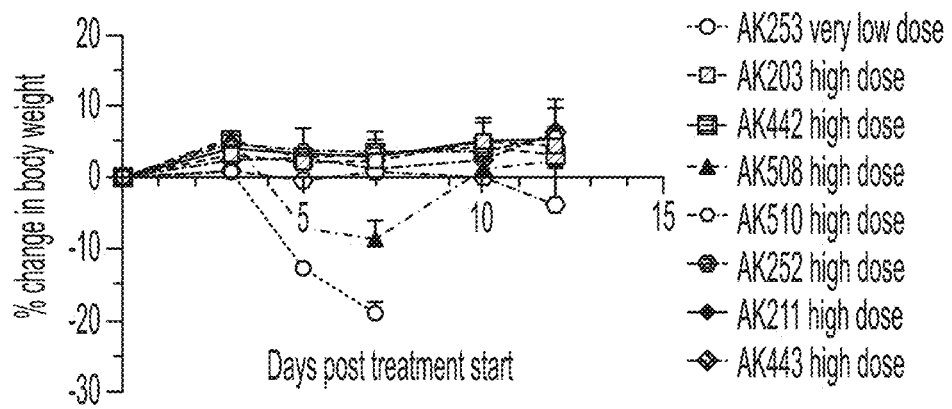
FIG. 38B shows change in body weight over time for different constructs and at very low dose and very high doses.

Results are shown in FIGS. 38A and 38B.

vi. Peripheral (Spleen) Vs Tumor CD8 T Cell Expansion—AK252, AK442, AK203, AK508 and AK510

C57BL/6 female mice were purchased from Charles River Laboratories and were 8-10 weeks old at the start of study. MC38 tumor cells (5×105 cells per mouse) were injected subcutaneously into the right flank of each mouse. Upon reaching ~100 mm3 sized tumors (day 0), the mice were randomized to receive AK253 at very low dose level and all other Fc-IL-2 constructs at high dose level in PBS. Mice were dosed intravenously on days 0, 3 and 6.

Figure 39A:
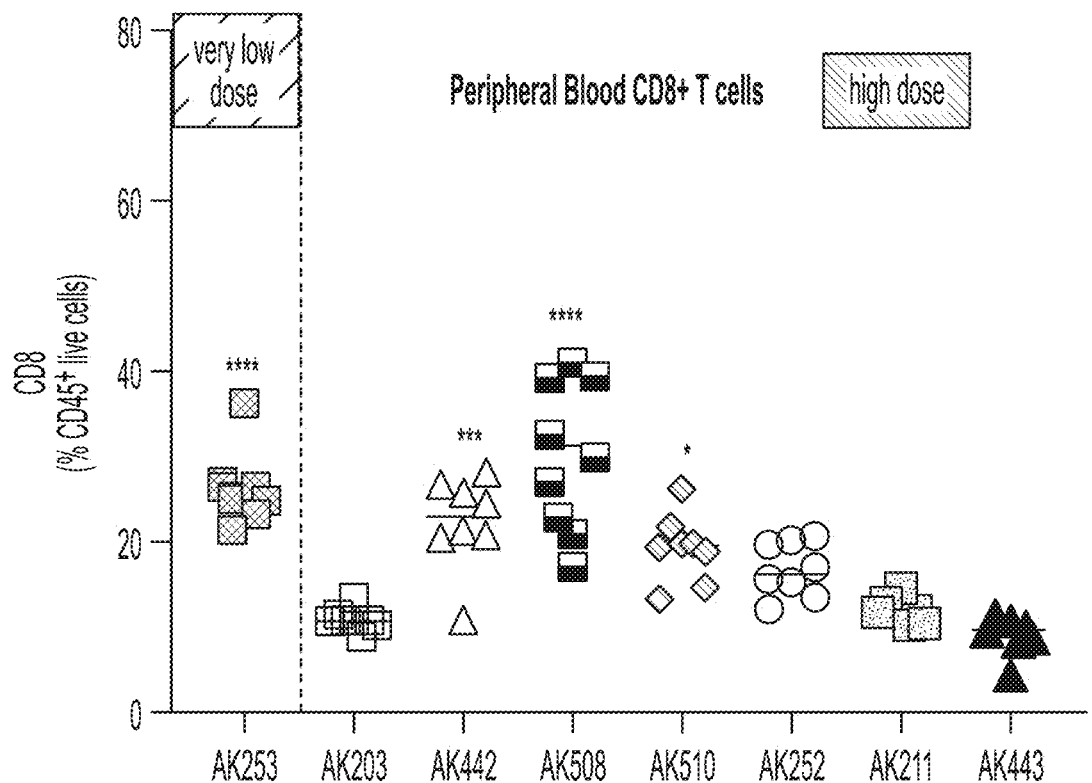
FIG. 39A shows percentage CD45$^+$ live cells for different constructs at high dose and very low dose.
Figure 39B:
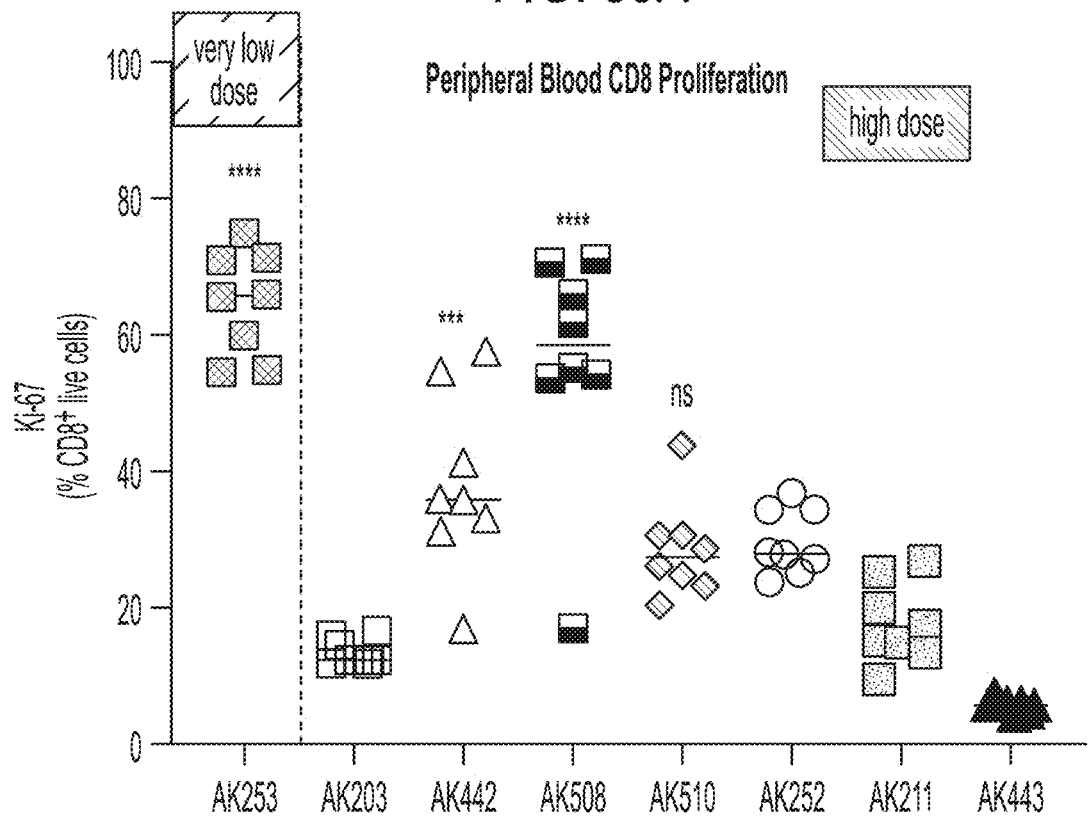
FIG. 39B shows percentage CD8$^+$ live cells for different constructs at high dose and very low dose.
Figure 41A:
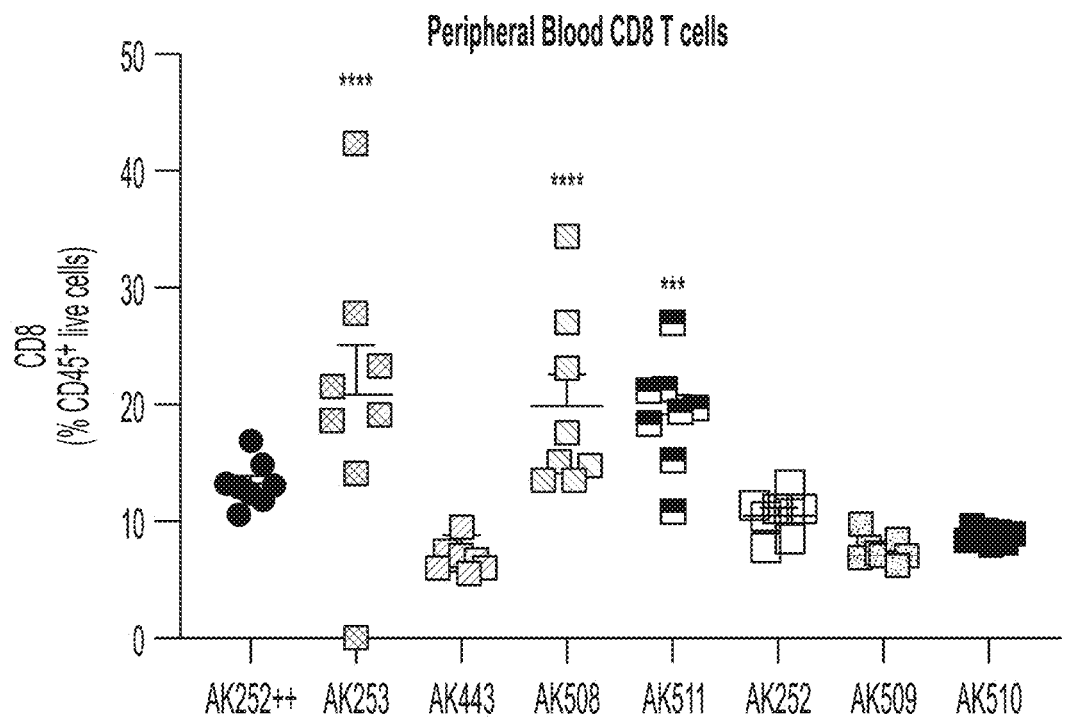
FIG. 41A shows percentage CD45$^+$ live cells for different constructs used in Example 6viii.
Figure 41B:
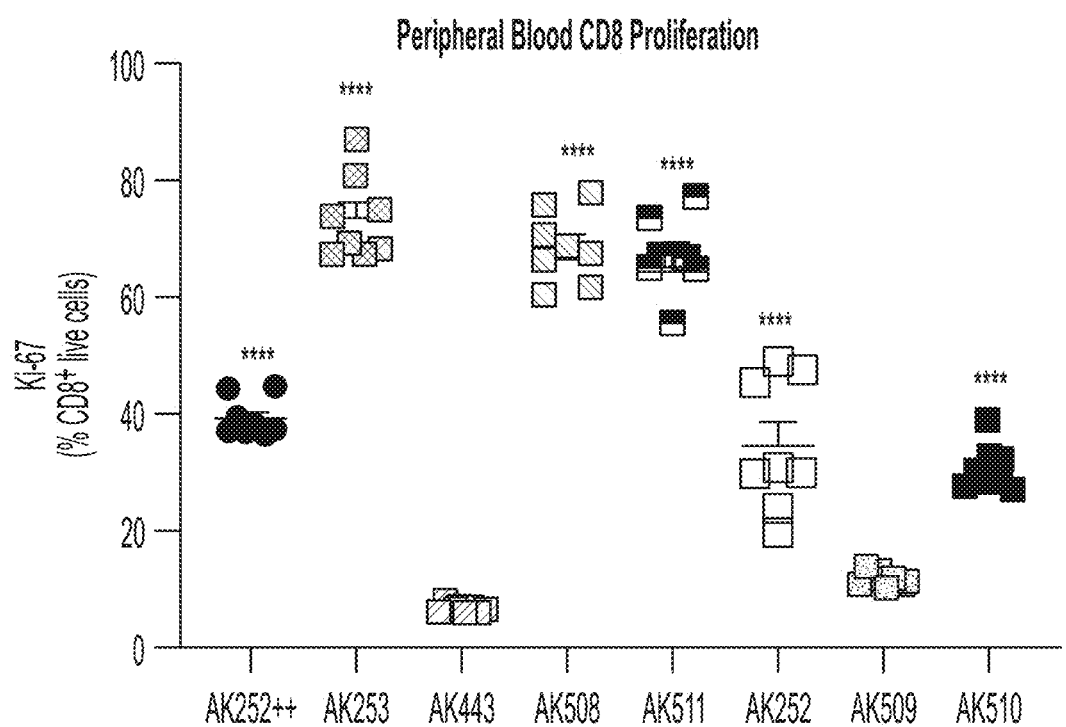
FIG. 41B shows percentage CD8$^+$ live cells for different constructs used in Example 6viii.

Immunophenotyping on day 7 was performed using a FACS-based method from peripheral blood. Red blood cells were lysed using ACK buffer (Gibco cat #A10492). The cell suspensions were stained with the following antibodies: CD45 (clone 30-F11, eBioscience), CD3 (clone 2C11, Biolegend), CD8 (clone 53-6.7, BD Biosciences), CD4 (clone RM-45, BD Biosciences) and Ki-67 (clone SOLA15, eBioscience). Data acquisition was carried out on the MACSQuant Analyzer flow cytometer (Milenyi) and data were analyzed using the FlowJo. A one-way ANOVA with Bonferonni's post-test was performed to determine the statistical significance of treatment vs. control AK211) (*P<0.05; P<0.01; *P<0.001; ****P<0.0001). Results are shown in FIGS. 39A and 39B.

vii. Anti-Tumor Activity—AK252, AK508, AK509, AK510, AK511

C57BL/6 female mice were purchased from Charles River Laboratories and were 8-10 weeks old at the start of study. MC38 tumor cells (5×105 cells per mouse) were injected subcutaneously into the right flank of each mouse. Upon reaching ~100 mm3 sized tumors (day 0), the mice were randomized to receive AK253 at very low dose level and all other Fc-IL-2 constructs at high dose level in PBS. Mice were dosed intravenously on days 0, 3 and 6. Tumor volume was calculated (Length*(Width^2)/2) using dial calipers and body weights were recorded twice weekly. Mice were sacrificed upon reaching humane end points of tumor burden (2000 mm3) or body weight loss due to toxicity (20%).

Results are shown in FIGS. 40A-40D.

viii. Peripheral (Spleen) Vs Tumor CD8 T Cell Expansion—AK252, AK508, AK509, AK510, AK511

C57BL/6 female mice were purchased from Charles River Laboratories and were 8-10 weeks old at the start of study. MC38 tumor cells (5×105 cells per mouse) were injected subcutaneously into the right flank of each mouse. Upon reaching ~100 mm3 sized tumors (day 0), the mice were randomized to receive AK253 at very low dose level and all other Fc-IL-2 constructs at high dose level in PBS. Mice were dosed intravenously on days 0, 3 and 6.

Immunophenotyping on day 7 was performed using a FACS-based method from peripheral blood. Red blood cells were lysed using ACK buffer (Gibco cat #A10492). The cell suspensions were stained with the following antibodies: CD45 (clone 30-F11, eBioscience), CD3 (clone 2C11, Biolegend), CD8 (clone 53-6.7, BD Biosciences), CD4 (clone RM-45, BD Biosciences) and Ki-67 (clone SOLA15, eBioscience). Data acquisition was carried out on the MACSQuant Analyzer flow cytometer (Milenyi) and data were analyzed using the FlowJo. A one-way ANOVA with Bonferonni's post-test was performed to determine the statistical significance of treatment vs. control AK211) (*P<0.05; P<0.01; *P<0.001; ****P<0.0001). AK252$^+$+ produced in-house lot #AK252-06B, AK252 produced by ATUM lot #AK252-A-01A. Results shown in FIGS. 41A and 41B.

ix. Anti-Tumor Activity—AK252, AK438, AK442, AK209, AK341

C57BL/6 female mice were purchased from Charles River Laboratories and were 8-10 weeks old at the start of study. MC38 tumor cells (5×105 cells per mouse) were injected subcutaneously into the right flank of each mouse. Upon reaching ~100 mm3 sized tumors (day 0), the mice were randomized to receive AK253 at very low dose level and all other Fc-IL-2 constructs at high dose level in PBS. Mice were dosed intravenously on days 0, 3 and 6. Tumor volume was calculated (Length*(Width^2)/2) using dial calipers and body weights were recorded twice weekly. Mice were sacrificed upon reaching humane end points of tumor burden (2000 mm3) or body weight loss due to toxicity (20%).

Figure 42A:
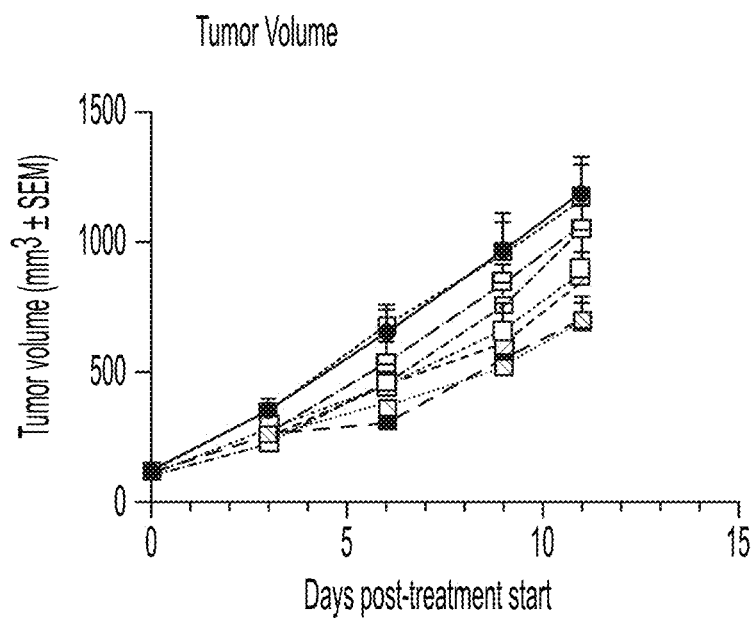
FIG. 42A shows changes in tumor volume over time for different constructs used in Example 6ix.
Figure 42B:
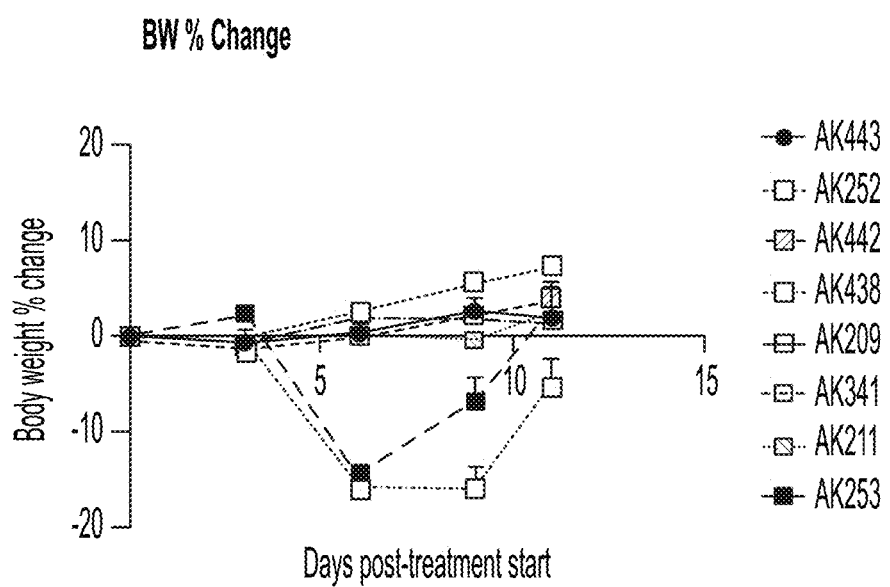
FIG. 42B shows changes in body weight upon treatment using different constructs used in Example 6ix.

Results are shown in FIGS. 42A and 42B.

x. Splenomegaly and Lung Edema—AK252, AK438, AK442, AK209, AK341

C57BL/6 female mice were purchased from Charles River Laboratories and were 8-10 weeks old at the start of study. MC38 tumor cells (5×105 cells per mouse) were injected subcutaneously into the right flank of each mouse. Upon reaching ~100 mm3 sized tumors (day 0), the mice were randomized to receive AK253 at very low dose level and all other Fc-IL-2 constructs at high dose level in PBS. Mice were dosed intravenously on days 0, 3 and 6. Tissues were harvested and weighed on day 6.

Figure 43A:
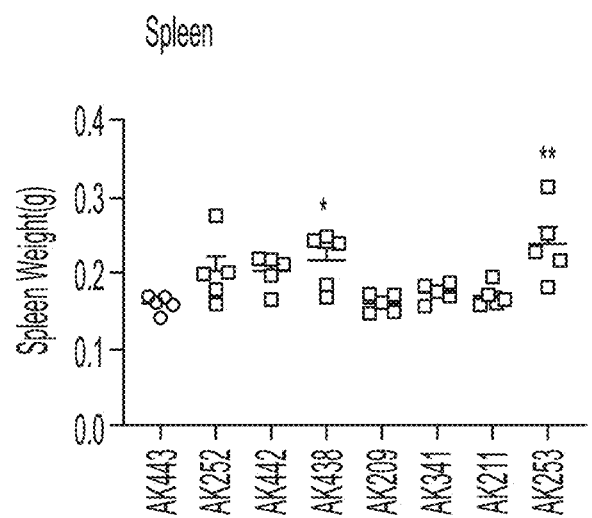
FIG. 43A shows weight of the spleen post-treatment for different constructs.
Figure 43B:
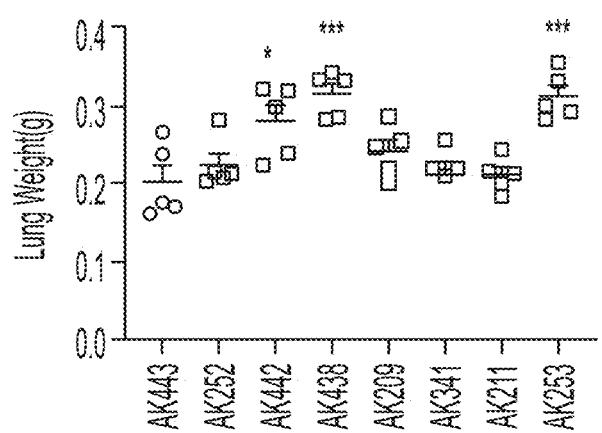
FIG. 43B shows weight of the lung post-treatment for different constructs.
Figure 44A:
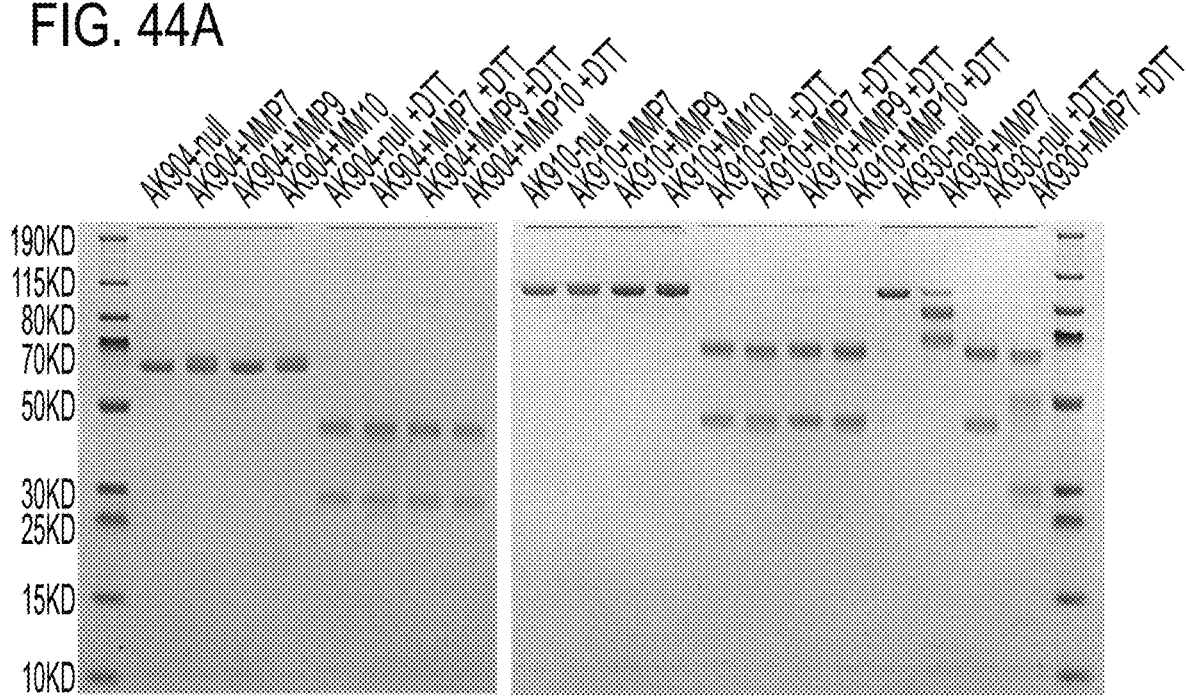
Figure 44B:
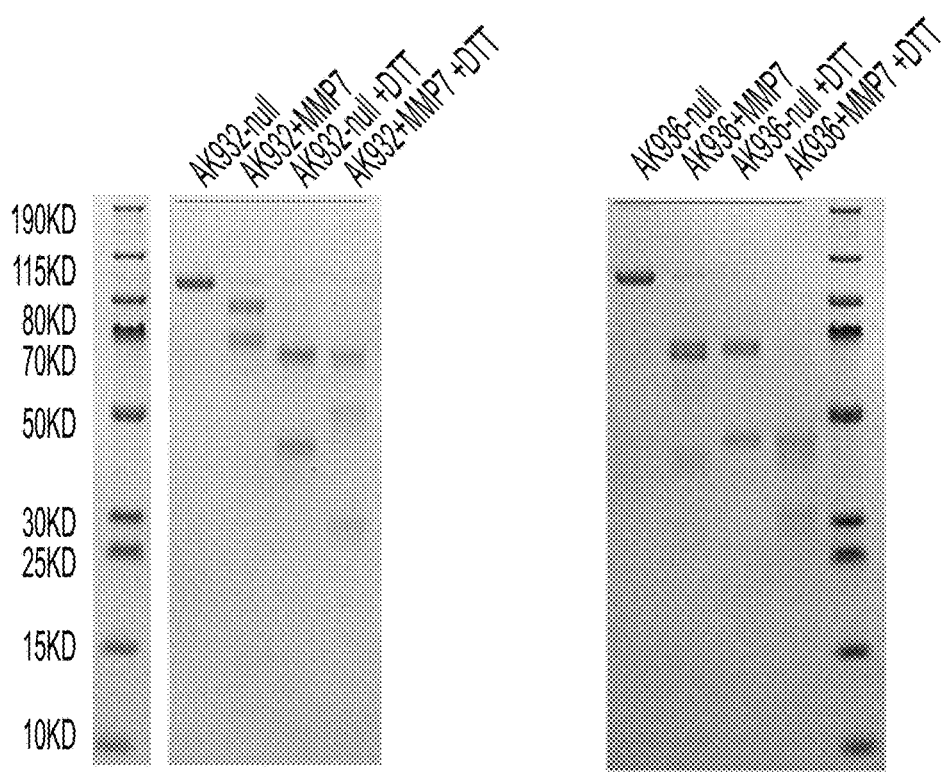
Figure 44C:
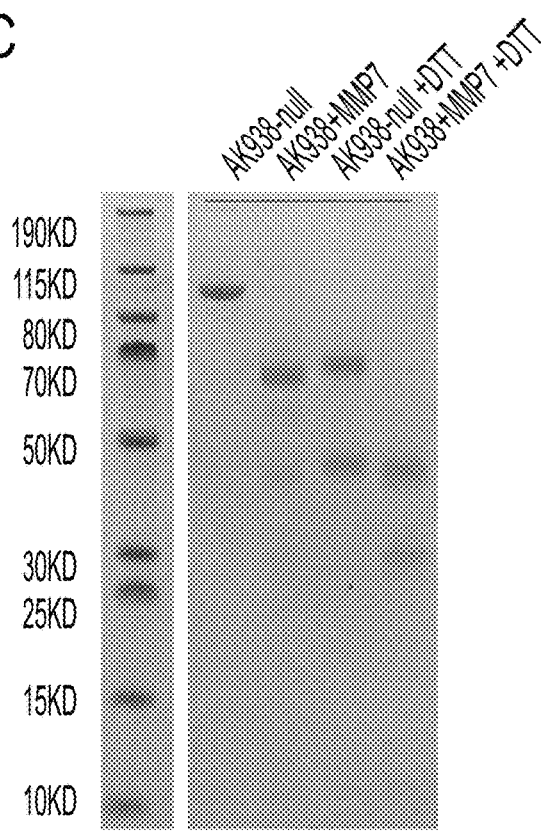
Figure 44D:
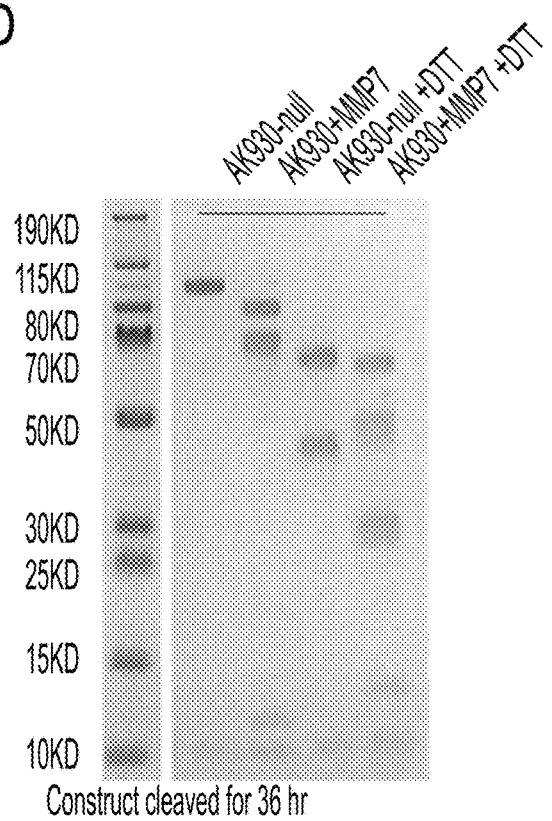

Results are shown in FIGS. 43A and 43B.

Example 7 i. Cleavage of Peptides by NAT Vs. RCC Culture Supernatant

Sequences comprising cleavage peptides (shown in bold below) were incubated in either 'NAT' (Normal Adjacent Tissue) or 'RCC' (Renal Cell Carcinoma) culture supernatants, to test the specificity of each peptide's cleavage.

To this end, peptide sequencing by mass spectrometry was used to identify cleaved fragments produced for the synthetic peptides shown in the table below, using a published technique called multiplexed substrate profiling by mass spectrometry (MSP-MS) (O'Donoghue A. J. et al. Nat Methods. 2012 November; 9(11):1095-100.) Cleavages were monitored in these reactions over time, and the peptides found to be cleaved in the earliest time points were deemed to be most sensitive to proteolytic activity in the conditioned media samples.

Results are as follows:

| Substrate | Synthetic Peptide Sequence (bolded sequences show the cleavable peptide; *indicates cleavage site) | NAT | RCC | Earliest cleaved time point-NAT | Earliest cleaved time point-RCC |
|---|---|---|---|---|---|
| AK-15 | RSG**VPLS*LYSG**SGGGK (SEQ ID NO: 145) | 0 | 3/5 | | 15 min |
| AK-18 | RSG**MP*YDLY*HPS**GK (SEQ ID NO: 146) | 5/5 | 5/5 | 15 min | 15 min |
| AK-21 | RGP**DSGGF*ML*TS**GK (SEQ ID NO: 147) | 3/5 | 5/5 | 15 min | 15 min |
| AK-28 | RGSGHEQLTVSGGSK (SEQ ID NO: 148) | 0 | 0 | | |
| AK-49 | RSG**R*AAAVKSPSG**K (SEQ ID NO: 149) | 0 | 3/5 | | 15-60-240 min |
| AK-02 | RGSG**ISSGLLSGRS*D*N*HS**GK (SEQ ID NO: 150) | 5/5 | 5/5 | 15-60 min | 15-60 min |
| AK-50 | RG**DLLAVVA*ASG**GK (SEQ ID NO: 151) | 0 | 5/5 | | 15-60 min |
| AK-88 | RG**GISSGLL*SG*R**SGK (SEQ ID NO: 152) | 0 | 5/5 | | 15-60 min |

Cleavage peptides DLLAVVA*AS (SEQ ID NO: 248) and ISSGLL*SG*RS (SEQ ID NO: 249) were found to be the most specific. Sequences comprising these peptides did not cleave in the NAT culture, but cleaved in every run in the RCC culture.

Example 8

The following constructs used in this example are shown in FIG. 69:

Details on the domain features and sequences of each AK molecule is as follows:

| AK904 | 1st polypeptide chain: Fc(Hole) | DKTHTCPPCPAPELLGGPSVFLFPPKPKDTLMIS RTPEVTCVVVDVSHEDPEVKFNWYVDGVEVHNAK TKPREEQYASTYRVVSVLTVLHQDWLNGKEYKCK VSNKALPAPIEKTISKAKGQPREPQVCTLPPSRD ELTKNQVSLSCAVKGFYPSDIAVEWESNGQPENN YKTTPPVLDSDGSFFLVSKLTVDKSRWQQGNVFS CSVMHEALHNHYTQKSLSLSPGK (SEQ ID NO: 79) | DNA158 |
|---|---|---|---|
| | 2nd polypeptide chain: Fc(knob)-IL15 V1 Non-cleavable (N71Q, N79Q) | DKTHTCPPCPAPELLGGPSVFLFPPKPKDTLMIS RTPEVTCVVVDVSHEDPEVKFNWYVDGVEVHNAK TKPREEQYASTYRVVSVLTVLHQDWLNGKEYKCK VSNKALPAPIEKTISKAKGQPREPQVYTLPPCRD ELTKNQVSLWCLVKGFYPSDIAVEWESNGQPENN YKTTPPVLDSDGSFFLYSKLTVDKSRWQQGNVFS CSVMHEALHNHYTQKSLSLSPGGGSSPPGGGSSG GGSGPSGSPGNWVNVISDLKKIEDLIQSMHIDAT LYTESDVHPSCKVTAMKCFLLELQVISLESGDAS IHDTVENLIILAQNSLSSNGQVTESGCKECEELE EKNIKEFLQSFVHIVQMFINTS (SEQ ID NO: 154) | AK904 |
| AK910 | 1st polypeptide chain: Fc(Hole) CD122(C122S, C168S) | DKTHTCPPCPAPELLGGPSVFLFPPKPKDTLMIS RTPEVTCVVVDVSHEDPEVKFNWYVDGVEVHNAK TKPREEQYASTYRVVSVLTVLHQDWLNGKEYKCK VSNKALPAPIEKTISKAKGQPREPQVCTLPPSRD ELTKNQVSLSCAVKGFYPSDIAVEWESNGQPENN YKTTPPVLDSDGSFFLVSKLTVDKSRWQQGNVFS CSVMHEALHNHYTQKSLSLSPGPGSGSAVNGTSQ FTCFYNSRANISCVWSQDGALQDTSCQVHAWPDR RRWNQTCELLPVSQASWACNLILGAPDSQKLTTV DIVTLRVLCREGVRWRVMAIQDFKPFENLRLMAP ISLQVVHIVETHRSNISWEISQASHYFERHLEFE ARTLSPGHTWEEAPLLTLKQKQEWISLETLTPDT QYEFQVRVKPLQGEFTTWSPWSQPLAFRTKPAAL GKD (SEQ ID NO: 39) | DNA440 |
| | 2nd polypeptide chain: Fc(knob)-IL15 V1 Non-cleavable (N71Q, N79Q) | DKTHTCPPCPAPELLGGPSVFLFPPKPKDTLMIS RTPEVTCVVVDVSHEDPEVKFNWYVDGVEVHNAK TKPREEQYASTYRVVSVLTVLHQDWLNGKEYKCK VSNKALPAPIEKTISKAKGQPREPQVYTLPPCRD ELTKNQVSLWCLVKGFYPSDIAVEWESNGQPENN YKTTPPVLDSDGSFFLYSKITVDKSRWQQGNVFS CSVMHEALHNHYTQKSLSLSPGGGSSPPGGGSSG GGSGPSGSPGNWVNVISDLKKIEDLIQSMHIDAT LYTESDVHPSCKVTAMKCFLLELQVISLESGDAS LHDTVENLIILAQNSLSSNGQVTESGCKECEELE EKNIKEFLQSFVHIVQMFINTS (SEQ ID NO: 154) | DNA904 |
| AK932 | 1st polypeptide chain: Fc(Hole) CD122(C122S, C168S) | DKTHTCPPCPAPELLGGPSVFLFPPKPKDTLMIS RTPEVTCVVVDVSHEDPEVKFNWYVDGVEVHNAK TKPREEQYASTYRVVSVLTVLHQDWLNGKEYKCK VSNKALPAPIEKTISKAKGQPREPQVCTLPPSRD ELTKNQVSLSCAVKGFYPSDIAVEWESNGQPENN YKTTPPVLDSDGSFFLVSKLTVDKSRWQQGNVFS CSVMHEALHNHYTQKSLSLSPGPGSGSAVNGTSQ FTCFYNSRANISCVWSQDGALQDTSCQVHAWPDR RRWNQTCELLPVSQASWACNLILGAPDSQKLTTV DIVTLRVLCREGVRWRVMAIQDFKPFENLRLMAP ISLQVVHVETHRSNISWEISQASHYFERHLEFEA RTLSPGHTWEEAPLLTLKQKQEWISLETLTPDTQ YEFQVRVKPLQGEFTTWSPWSQPLAFRTKPAALG KD (SEQ ID NO: 39) | DNA440 |
| | 2nd polypeptide chain: Fc(knob)- [DLLAVVAA]- IL15 (N71Q, N79Q) *cleavable peptide bolded | DKTHTCPPCPAPELLGGPSVFLFPPKPKDTLMIS RTPEVTCVVVDVSHEDPEVKFNWYVDGVEVHNAK TKPREEQYASTYRVVSVLTVLHQDWLNGKEYKCK VSNKALPAPIEKTISKAKGQPREPQVYTLPPCRD ELTKNQVSLWCLVKGFYPSDIAVEWESNGQPENN YKTTPPVLDSDGSFFLYSKLTVDKSRWQQGNVFS CSVMHEALHNHYTQKSLSLSPGSGSDLLAVVAAS SGPGSGNWVNVISDLKKIEDLIQSMHIDATLYTE SDVHPSCKVTAMKCFLLELQVISLESGDASIHDT VENLIILAQNSLSSNGQVTESGCKECEELEEKNI KEFLQSFVHIVQMFINTS (SEQ ID NO: 158) | DNA924 |
| AK938 | 1st polypeptide chain: Fc(hole)- [DLLAVVAA]- | DKTHTCPPCPAPELLGGPSVFLFPPKPKDTLMIS RTPEVTCVVVDVSHEDPEVKFNWYVDGVEVHNAK TKPREEQYASTYRVVSVLTVLHQDWLNGKEYKCK VSNKALPAPIEKTISKAKGQPREPQVCTLPPSRD | DNA822 |

|  |  |  |  |
|---|---|---|---|
| | CD122<br>*cleavable<br>peptide bolded | ELTKNQVSLSCAVKGFYPSDIAVEWESNGQPENN<br>YKTTPPVLDSDGSFFLVSKLTVDKSRWQQGNVFS<br>CSVMHEALHNHYTQKSLSLSPGSGSPSGDLLAVV<br>AASSGPGSQSPAVNGTSQFTCFYNSRANISCVWS<br>QDGALQDTSCQVHAWPDRRRWNQTCELLPVSQAS<br>WACNLILGAPDSQKLTTVDIVTLRVLCREGVRWR<br>VMAIQDFKPFENLRLMAPISLQVVHVETHRSNIS<br>WEISQASHYFERHLEFEARTLSPGHTWEEAPLLT<br>LKQKQEWISLETLTPDTQYEFQVRVKPLQGEFTT<br>WSPWSQPLAFRTKPAALGKD<br>(SEQ ID NO: 159) | |
| | 2<sup>nd</sup> polypeptide<br>chain:<br>Fc(knob)-IL15<br>V1 Non-<br>cleavable<br>(N71Q, N79Q) | DKTHTCPPCPAPELLGGPSVFLFPPKPKDTLMIS<br>RTPEVTCVVVDVSHEDPEVKFNWYVDGVEVHNAK<br>TKPREEQYASTYRVVSVLTVLHQDWLNGKEYKCK<br>VSNKALPAPIEKTISKAKGQPREPQVYTLPPCRD<br>ELTKNQVSLWCLVKGFYPSDIAVEWESNGQPENN<br>YKTTPPVLDSDOSFFLYSKLTVDKSRWQQGNVFS<br>CSVMHEALHNHYTQKSLSLSPGGGSSPPGGGSSG<br>GGSGPSGSPGNWVNVISDLKKIEDLIQSMHIDAT<br>LYTESDVHPSCKVTAMKCFLLELQVISLESGDAS<br>IHDTVENLIILAQNSLSSNGQVTESGCKECEELE<br>EKNIKEFLQSFVHIVQMFINTS<br>(SEQ ID NO: 154) | DNA904 |
| AK930 | 1<sup>st</sup> polypeptide<br>chain:<br>Fc(hole)<br>CD122(C122S,<br>C168S) | DKTHTCPPCPAPELLGGPSVFLFPPKPKDTLMIS<br>RTPEVTCVVVDVSHEDPEVKFNWYVDGVEVHNAK<br>TKPREEQYASTYRVVSVLTVLHQDWLNGKEYKCK<br>VSNKALPAPIEKTISKAKGQPREPQVCTLPPSRD<br>ELTKNQVSLSCAVKGFYPSDIAVEWESNGQPENN<br>YKTTPPVLDSDGSFFLVSKLTVDKSRWQQGNVFS<br>CSVMHEALHNHYTQKSLSLSPGPGSGSAVNGTSQ<br>FTCFYNSRANISCVWSQDGALQDTSCQVHAWPDR<br>RRWNQTCELLPVSQASWACNLILGAPDSQKLTTV<br>DIVTLRVLCREGVRWRVMAIQDFKPFENLRLMAP<br>ISLQVVHIVETHRSNISWEISQASHYFERHLEFE<br>ARTLSPGHTWEEAPLLTLKQKQEWISLETLTPDT<br>QYEFQVRVKPLQGEFTTWSPWSQPLAFRTKPAAL<br>GKD (SEQ ID NO: 39) | DNA440 |
| | 2<sup>nd</sup> polypeptide<br>chain:<br>Fc(knob)-<br>(ISSGLLSGR)<br>IL15<br>(N71Q, N799)<br>*cleavable<br>peptide bolded | DKTHTCPPCPAPELLGGPSVFLFPPKPKDTLMIS<br>RTPEVTCVVVDVSHEDPEVKFNWYVDGVEVHNAK<br>TKPREEQYASTYRVVSVLTVLHQDWLNGKEYKCK<br>VSNKALPAPIEKTISKAKGQPREPQVYTLPPCRD<br>ELTKNQVSLWCLVKGFYPSDIAVEWESNGQPENN<br>YKTTPPVLDSDGSFFLYSKLTVDKSRWQQGNVFS<br>CSVMHEALHNHYTQKSLSLSPGGGSSGGSPISSG<br>LLSGRSSGPGSGSNWVNVISDLKKIEDLIQSMHI<br>DATLYTESDVHPSCKVTAMKCFLLELQVISLESG<br>DASIHDTVENLIILAQNSLSSNGQVTESGCKECE<br>ELEEKNIKEFLQSFVHIVQMFINTS<br>(SEQ ID NO: 162) | DNA922 |
| AK936 | 1<sup>st</sup> polypeptide<br>chain:<br>Fc(hole)-<br>(ISSGLLSGR)<br>CD122 | DKTHTCPPCPAPELLGGPSVFLFPPKPKDTLMIS<br>RTPEVTCVVVDVSHEDPEVKFNWYVDGVEVHNAK<br>TKPREEQYASTYRVVSVLTVLHQDWLNGKEYKCK<br>VSNKALPAPIEKTISKAKGQPREPQVCTLPPSRD<br>ELTKNQVSLSCAVKGFYPSDIAVEWESNGQPENN<br>YKTTPPVLDSDGSFFLVSKLTVDKSRWQQGNVFS<br>CSVMHEALHNHYTQKSLSLSPGGPPSGSSPISSG<br>LLSGRSSGGGAVNGTSQFTCFYNSRANISCVWSQ<br>DGALQDTSCQVHAWPDRRRWNQTCELLPVSQASW<br>ACNLILGAPDSQKLTTVDIVTLRVLCREGVRWRV<br>MAIQDFKPFENLRLMAPISLQVVHVETHRSNISW<br>EISQASHYFERHLEFEARTLSPGHTWEEAPLLTL<br>KQKQEWISLETLTPDTQYEFQVRVKPLQGEFTTW<br>SPWSQPLAFRTKPAALGKD<br>(SEQ ID NO: 163) | DNA823 |
| | 2<sup>nd</sup> polypeptide<br>chain:<br>Fc(knob)-IL15<br>V1 Non-<br>cleavable<br>(N71Q, N79Q) | DKTHTCPPCPAPELLGGPSVFLFPPKPKDTLMIS<br>RTPEVTCVVVDVSHEDPEVKFNWYVDGVEVHNAK<br>TKPREEQYASTYRVVSVLTVLHQDWLNGKEYKCK<br>VSNKALPAPIEKTISKAKGQPREPQVYTLPPCRD<br>ELTKNQVSLWCLVKGFYPSDIAVEWESNGQPENN<br>YKTTPPVLDSDGSFFLYSKLTVDKSRWQQGNVFS<br>CSVMHEALHNHYTQKSLSLSPGGGSSPPGGGSSG<br>GGSGPSGSPGNWVNVISDLKKIEDLIQSMHIDAT | DNA904 |

```
LYTESDVHPSCKVTAMKCFLLELQVISLESGDAS
IHDTVENLIILAQNSLSSNGQVTESGCKECEELE
EKNIKEFLQSFVHIVQMFINTS
(SEQ ID NO: 154)
```

Importantly, AK932 and AK930, and their 'flipped' counterparts AK938 and AK936 include a peptide substrate (the sequence of which is depicted in the box above each molecule and bolded in the sequence table table). AK904 is a non-cleavable unmasked construct, and AK910 is a non-cleavable masked construct, both acting as negative controls.

The above AK molecules include an IL-15 domain, however it will be appreciated that however the results and conclusions of this data are equally relevant for IL-2 constructs.

Cleavage was Achieved for Masked Constructs Including a Peptide Substrate.

Constructs were incubated with MMP7, 9 and 10. Cleavage for each construct was analysed by SDS-PAGE and confirmed by HEK-Blue IL-2 bioassay.

Figure 70:
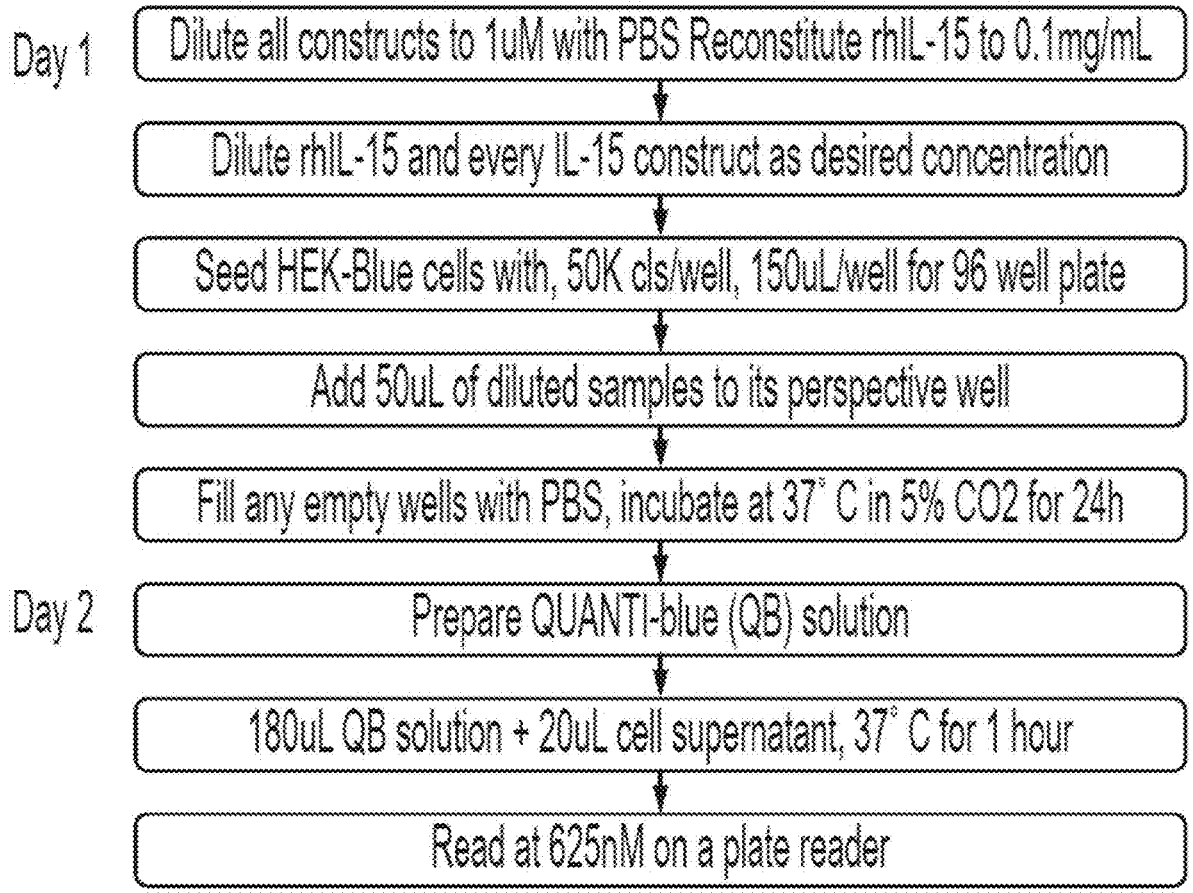
FIG. 70 shows the flowchart for HEK-Blue IL-2 bioassay, as described in Example 8.

The HEK-Blue assay was carried out as follows:

Conditions: Cell plate: 96 well plate. Cell density: 50K cls/well. Time point for HEK Blue detection were tested: 1 h. Construct number: Total 14 constructs that were tested. Assay Flow chart is shown in FIG. 70.

The results are shown in the table below, where a 'X' indicates not fully cleaved and a '√' indicates cleavage:

| ID | MMP | Cleavage |
| --- | --- | --- |
| AK904 | 7 | X |
|  | 9 | X |
|  | 10 | X |
| AK910 | 7 | X |
|  | 9 | X |
|  | 10 | X |
| AK932 | 7 | √ |
|  | 9 | — |
|  | 10 | — |
| AK938 | 7 | √ |
|  | 9 | — |
|  | 10 | — |
| AK930 | 7 (36 hr) | √ |
|  | 9 | — |
|  | 10 | — |
| AK936 | 7 | √ |
|  | 9 | — |
|  | 10 | — |

The specific $EC_{50}$ readout results from the HEK-Blue IL-2 bioassay are shown in the table below.

| ID | MMP | EC50 (pM) | Max |
| --- | --- | --- | --- |
| AK904 (1:1:2) | — | 14.78 | 1.44 |
|  | 7 | 17.08 | 1.37 |
|  | 9 | 16.00 | 1.43 |
|  | 10 | 22.93 | 1.45 |
| AK910 (1:1:2) | — | 1219.34 | 1.31 |
|  | 7 | 284.17 | 1.42 |
|  | 9 | 519.09 | 1.40 |
|  | 10 | 490.52 | 1.40 |
| AK932 (1:1:2) | — | 2403.11 | 1.22 |
|  | 7 | 9.30 | 1.43 |
|  | 9 | — | — |
|  | 10 | — | — |
| AK938 (1:1:2) | — | 885.13 | 1.31 |
|  | 7 | 18.03 | 1.38 |
|  | 9 | — | — |
|  | 10 | — | — |
| AK930 (1:1:2) | — | 1858.76 | 1.22 |
|  | 7 | 8.00 | 1.41 |
|  | 9 | — | — |
|  | 10 | — | — |
| AK936 (1:1:2) | — | 785.85 | 1.37 |
|  | 7 | 16.11 | 1.40 |
|  | 9 | — | — |
|  | 10 | — | — |

The SDS-PAGE gel results are shown in FIGS. 44A-D. The HEK-Blue IL-2 bioassay results are shown in FIGS. 45A-F.

Example 9

This example demonstrates the masking and cleavage of exemplary IL-12 constructs.

```
AK671  1st polypeptide chain
       DKTHTCPPCPAPELLGGPSVFLFPPKPKDTLMISRTPEVTCVVVDVSHEDPEVKFNW
       YVDGVEVHNAKTKPREEQYASTYRVVSVLTVLHQDWLNGKEYKCKVSNKALPARIEK
       TISKAKGQPREPQVCTLPPSRDELTKNQVSLSCAVKGFYPSDIAVEWESNGQPENNY
       KTTPPVLDSDGSFFLVSKLTVDKSRWQOOGNVFSCSVMHEALHNHYTQKSLSLSPGK
       (SEQ ID NO: 79)

2nd polypeptide chain
       DKTHTCPPCPAPELLGGPSVFLFPPKPKDTLMISRTPEVTCVVVDVSHEDPEVKFNW
       YVDGVEVHNAKTKPREEQYASTYRVVSVLTVLHQDWLNGKEYKCKVSNKALPAPIEK
       TISKAKGQPREPQVYTLPPCRDELTKNQVSLWCLVKGFYPSDIAVEWESNGQPENNY
       KTTPPVLDSDGSFFLYSKLTVDKSRWQQGNVFSCSVMHEALHNHYTQKSLSLSPGGG
       SGGSGGSGGSGGSSGPIWELKKDVYVVELDWYPDAPGEMVVLTCDTPEEDGITWTLD
       QSSEVLGSGKTLTIQVKEFGDAGQYTCHKGGEVLSHSLLLLHKKEDGIWSTDILKDQ
       KEPKNKTFLRCEAKNYSGRFTCWWLTTISTDLTFSVKSSRGSSDPQGVTCGAATLSA
       ERVRGDNKEYEYSVECQEDSACPAAEESLPIEVMVDAVHKLKYENYTSSFFIRDIIK
       PDPPKNLQLKPLKNSRQVEVSWEYPDTWSTPHSYFSLTFSVQVQGKDNTEGRVFTDK
       TSATVICRKNASISVRAQDRYYSSSWSEWASVPCSGGGGSGGGGSGGGGSRNLPVAT
       PDPGMFPCLHHSQNLLRAVSNMLQKARQTLEFYPCTSEEIDHEDITKDKTSTVEACL
       PLELTKNESCLNSRETSFITNGSCLASRKTSFMMALCLSSIYEDLKMYQVEFKTMNA
```

|     |     |
| --- | --- |
|     | KLLMDPKRQIFLDQNMLAVIDELMQALNFNSETVPQKSSLEEPDFYKTKIKLCILLH<br>AFRIRAVTIDRVMSYLNAS (SEQ ID NO: 171) |
| AK663 | 1<sup>st</sup> polypeptide chain<br>DKTHTCPPCPAPELLGGPSVELEPPKPKDTLMISRTPEVTCVVVDVSHEDPEVKFNW<br>YVDGVEVHNAKTKPREEQYASTYRVVSVLTVLHQDWLNGKEYKCKVSNKALPAPIEK<br>TISKAKGQPREPQVCTLPPSRDELTKNQVSLSCAVKGFYPSDIAVEWESNGQPENNY<br>KTTPPVLDSDGSFFLVSKLTVDKSRWQQGNVFSCSVMHEALHNHYTQKSLSLSPGGG<br>SPGKIDACKRGDVTVKPSHVILLGSTVNITCSLKPRQGCFHYSRRNKLILYKFDRRI<br>NFHHGHSLNSQVTGLPLGTTLFVCKLACINSDEIQICGAEIFVGVAPEQPQNLSCIQ<br>KGEQGTVACTWERGRDTHLYTEYTLQLSGPKNLTWQKQCKDIYCDYLDFGINLTPES<br>PESNFTAKVTAVNSLGSSSSLPSTFTFLDIVRPLPPWDIRIKFQKASVSRSTLYWRD<br>EGLVLLNRLRYRPSNSRLWNMVNVTKAKGRHDLLDLKPFTEYEFQISSKLHLYKGSW<br>SDWSESLRAQTPEE (SEQ ID NO: 172) |
|     | 2<sup>nd</sup> polypeptide chain<br>DKTHTCPPCPAPELLGGPSVFLFPPKPKDTLMISRTPEVTCVVVDVSHEDPEVKFNW<br>YVDGVEVHNAKTKPREEQYASTYRVVSVLTVLHQDWLNGKEYKCKVSNKALPAPIEK<br>TISKAKGQPREPQVYTLPPCRDELTKNQVSLWCLRGFYPSDIAVEWESNGQPENNYK<br>TTPPVLDSDGSFFLYSKLTVDKSRWQQGNVFSCSVMBEALHNHYTQKSLSLSPGK<br>(SEQ ID NO: 173) |
| AK664 | 1<sup>st</sup> polypeptide chain<br>DKTHTCPPCPAFELLGGPSVFLFPPKPKDTLMISRTPEVTCVVVDVSHEDPEVKFNW<br>YVDGVEVHNAKTKPREEQYASTYRVVSVLTVLHQDWLNGKEYKCKVSNKALPAPIEK<br>TISKAKGQPREPQVCTLPPSRDELTKNQVSLSCAVKGFYPSDIAVEWESNGQPENNY<br>KTTPPVLDSDGSFFLVSKLTVDKSRWQQGNVFSCSVMHEALHNHYTQKSLSLSPGGG<br>SPGKIDACKRGDVTVKPSHVILLGSTVNITCSLKPRQGCFHYSRRNKLILYKFDRRI<br>NFHHGHSLNSQVTGLPLGTTLFVCKLACINSDEIQICGAEIFVGVAPEQPQNLSCIQ<br>KGEQGTVACTWERGRDTHLYTEYTLQLSGPKNLTWQKQCKDIYCDYLDFGINLTPES<br>PESNFTAKVTAVNSLGSSSSLPSTFTFLDIVRPLPPWDIRIKFQKASVSFSTLYWRD<br>EGLVLLNRLRYRPSNSRLWNMVNVTKAKGRHDLLDLKPFTEYEFQISSKHLYKGSWS<br>DWSESLRAQTPEE (SEQ ID NO: 172) |
|     | 2<sup>nd</sup> polypeptide chain<br>DKTHTCPPCPAPELLGGPSVFLFPPKPKDTLMISRTPEVTCVVVDVSHEDPEVKFNW<br>YVDGVEVHNAKTKPREEQYASTYRVVSVLTVLHQDWLNGKEYKCKVSNKALPAPIEK<br>TISKAKGQPREPQVYTLPPCRDELTKNQVSLWCLVKGFYPSDIAVEWESNGQPENNY<br>KTTPPVLDSDGSFFLYSKLTVDKSRWQQGNVFSCSVMHEALHNHYTQKSLSLSPGGG<br>SGGSGGSGGSGGSSGPIWELKKDVYVVELDWYPDAPGEMVVLTCDTPEEDGITWTLD<br>QSSEVLGSGKTLTIQVKEFGDAGQYTCHKGGEVLSHSLLLLHKKEDGIWSTDILKDQ<br>KEPKNKTFLRCEAKNYSGRFTCWWLTTISTDLTFSVKSSRGSSDPQGVTCGAATLSA<br>ERVRGDNKEYEYSVECQEDSACPAAEESLPIEVMVDAVHKLKYENYTSSFFIRDIIK<br>PDPPKNLQLKPLKNSRQVEVSWEYPDTWSTPHSYFSLTFSVQVQGKDNTEGRVFTDK<br>TSATVICRKNASISVRAQDRYYSSSWSEWASVPCSGGGGSGGGGSGGGGSRNLPVAT<br>PDPGMFPCLHHSQNLLRAVSNMLQKARQTLEFYPCTSEEIDHEDITKDKTSTVEACL<br>PLELTKNESCLNSRETSFITNGSCLASRKTSFMMALCLSSIYEDLKMYQVEFKTMNA<br>KLLMDPRRQIPLDQNMLAVIDELMQALNFNSETVPQKSSLEEPDFYKTKIKLCILLH<br>AFRIRAVTIDRVNSYLNAS (SEQ ID NO: 171) |
| AK665 | 1<sup>st</sup> polypeptide chain<br>DKTHTCPPCPAPELLGGPSVFLFPPKPKDTLMISRTPEVTCVVVDVSHEDPEVKFNW<br>YVDGVEVHNAKTKPREEQYASTYRVVSVLTVLHQDWLNGKEYKCKVSNKALPAPIEK<br>TISKAKGQPREPQVCTLPPSRDELTKNQVSLSCAVKGFYPSDIAVEWESNGQPENNY<br>KTTPPVLDSDGSFFLVSKLTVDKSRWQQGNVFSCSVMHEALHNHYTQKSLSLSPGGG<br>SPGKIDACKRGDVTVKPSHVILLGSTVNITCSLKPRQGCFHYSRRNKLILYKFDRRI<br>NFHHGHSLNSQVTGLPGTTLFVCKLACINSDEIQICGAEIFVGVAPEQPQNLSCIQ<br>KGEQGTVACTWERGRDTHLYTEYTLQLSGPKNLTWQKQCKDIYCDYLDFGINLTPES<br>PESNFTAKVTAVNSLGSSSSLPSTFTFLDIVRPLPPWDIRIKFQKASVSRSTLYWRD<br>EGLVLLNRLRYRPSNSRLWNMVNVTKAKGRHDLLDLKPFTEYEFQISSKLHLYKGSW<br>SDWSESLRAQTPEE (SEQ ID NO: 172) |
|     | 2<sup>nd</sup> polypeptide chain<br>DKTHTCPPCPAPELLGGPSVFLFPPKPKDTLMISRTPEVTCVVVDVSHEDPEVKFNW<br>YVDGVEVHNAKTKPREEQYASTYRVVSVLTVLHQDWLNGKEYKCKVSNKALPAPIEK<br>TISKAKGQPREPQVYTLPPCRDELTKNQVSLWCLVKGFYPSDIAVEWESNGQPENNY<br>KTTPPVLDSDGSFFLYSKLTVDKSRWQQGNVFSCSVMHEALHNHYTQKSLSLSPGGG<br>SGGSGGSVPLSLYSGPIWELKKDVYVVELDWYPDAPGEMVVLTCDTPEEDGITWTLD<br>QSSEVLGSGKTLTIQVKEFGDAGQYTCHKGGEVLSHSLLLLHKKEDGIWSTDILKDQ<br>KEPKNKTFLRCEAKNYSGRFTCWWLTTISTDLTFSVKSSRGSSDPQGVTCGAATLSA<br>ERVRGDNKEYEYSVECQEDSACPAAEESLPIEVMVDAVHKLKYENYTSSFFIRDIIK<br>PDPPKNLQLKPLKNSRQVEVSWEYPDTWSTPHSYFSLTFSVQVQGKDNTEGRVFTDK<br>TSATVICRKNASISVRAQDRYYSSSWSEWASVPCSGGGGSGGGGSGGGGSRNLPVAT<br>PDPGMFPCLHHSQNLLRAVSNMLQKARQTLEFYPCTSEEIDHEDITKDKTSTVEACL<br>PLELTKNESCLNSRETSFITNGSCLASRKTSFMMALCLSSIYEDLEMYQVEFKTMNA<br>KLLMDPERQIFLDQNMLAVIDELMQALNFNSETVPQKSSLEEPDFYKTKIKLCILLH<br>AFRIRAVTIDRVMSYLNAS (SEQ ID NO: 177) |

AK666  1<sup>st</sup> polypeptide chain
       DKTHTCPPCPAPELLGGPSVFLFPPKPKDTLMISRTPEVTCVVVDVSHEDPEVKFNW
       YVDGVEVHNAKTKPREEQYASTYRVVSVLTVLHQDWLNGKEYKCKVSNKALPAPIEK
       TISKAKGQPREPQVCTLPPSRDELTKNQVSLSCAVKGFYPSDIAVEWESNGQPENNY
       KTTPPVLDSDGSFFLVSKLTVDKSRWQQGNVFSCSVMHEALHNHYTQKSLSLSPGPG
       GSGPKIDACKRGDVTVKPSHVILLGSTVNITCSLKPRQGCFHYSRRNKLILYKFDRR
       INFHHGHSLNSQVTGLPLGTTLFVCKLACINSDEIQICGAEIFVGVAPEQPQNLSCI
       QKGEQGTVACTWERGRDTHLYTEYTLQLSGPKNLTWQKQCKDIYCDYLDFGINLTPE
       SPESNFTAKVTAVNSLGSSSSLPSTFTFLDIVRPLPPWDIRIKFQKASVSRSTLYWR
       DEGLVLLNRLRYRPSNSRLNNMVNVTKAKGRHDLLDLKPFTEYEFQISSKLHLYKGS
       WSDWSESLRAQTPEE (SEQ ID NO: 178)

2<sup>nd</sup> polypeptide chain
       DKTHTCPPCPAPELLGGPSVFLFPPKPKDTLMISRTPEVTCVVVDVSHEDPEVKFNW
       YVDGVEVHNAKTKPREEQYASTYRVVSVLTVLHQDWLNGKEYKCKVSNKALPAPIEK
       TISKAKGQPREPQVYTLPPCRDELTKNQVSLWCLVKGFYPSDIAVEWESNGQPENNY
       KTTPPVLDSDGSFFLYSKLTVDKSRWQQGNVFSCSVMHEALHNHYTQKSLSLSPGGG
       SGGSVPLSLYSGPIWELKKDVYVVELDWYPDAPGEMVVLTCDTPEEDGITWTLDQSS
       EVLGSGKTLTIQVKEFGDAGQYTCHKGGEVLSHSLLLLHKKEDGIWSTDILKDQKEP
       KNKTFLRCEAKNYSGRFTCWWLTTISTDLTFSVKSSRGSSDPQGVTCGAATLSAERV
       RGDNKEYEYSVECQEDSACPAAEESLPIEVMVDAVHKLKYENYTSSFFIRDIIKPDP
       PKNLQLKPLKNSRQVEVSWEYPDTWSTPHSYFSLTFSVQVQGKDNTEGRVFTDKTSA
       TVICRKNASISVRAQDRYYSSSWSEWASVPCSGGGGSGGGGSGGGGSRNLPVATPDP
       GMFPCLHHSQNLLRAVSNMLQKARQTLEFYPCTSEEIDHEDITKDKTSTVEACLPLE
       LTKNESCLNSRETSFITNGSCLASRKTSFMMALCLSSIYEDLKMYQVEFKTMNAKLL
       MDPKRQIFLDQNMLAVIDELMQALNFNSETVPQKSSLEEPDFYKTKIKLCILLHAFR
       IRAVTIDRVMSYLNAS (SEQ ID NO: 179)

AK667  1<sup>st</sup> polypeptide chain
       DKTHTCPPCPAPELLGGPSVFLFPPKPKDTLMISRTPEVTCVVVDVSHEDPEVKFNW
       YVDGVEVHNAKTKPREEQYASTYRVVSVLTVLHQDWLNGKEYKCKVSNKALPAPIEK
       TISKAKGQPREPQVCTLPPSRDELTKNQVSLSCAVKGFYPSDIAVEWESNGQPENNY
       KTTPPVLDSDGSFFLVSKLTVDKSRWQQGNVFSCSVMHEALHNHYTQKSLSLSPGPG
       GSGPKIDACKRGDVTVKPSHVILLGSTVNITCSLKPRQGCFHYSRRNKLILYKFDRR
       INFHHGHSLNSQVTGLPLGTTLFVCKLACINSDEIQICGAEIFVGVAPEQPQNLSCI
       QKGEQGTVACTWERGRDTHLYTEYTLQLSGPKNLTWQKQCKDIYCDYLDFGINLTPE
       SPESNFTAKVTAVNSLGSSSSLPSTFTFLDIVRPLPPWDIRIKFQKASVSRSTLYWR
       DEGLVLLNRLRYRPSNSRLWNMVNVTKAKGRHDLLDLKPFTEYEFQISSKLHLYKGS
       WSDWSESLRAQTPEE (SEQ ID NO: 178)

2<sup>nd</sup> polypeptide chain
       DKTHTCPPCPAPELLGGPSVFLFPPKPKDTLMISRTPEVTCVVVDVSHEDPEVKFNW
       YVDGVEVHNAKTKPREEQYASTYRVVSVLTVLHQDWLNGKEYKCKVSNKALPAPIEK
       TISKAKGQPREPQVYTLPPCRDELTKNQVSLWCLVKGFYPSDIAVEWESNGQPENNY
       KTTPPVLDSDGSFFLYSKLTVDKSRWQQGNVFSCSVMHEALHNHYTQKSLSLSPGGG
       SGGSMPYDLYHPSGPIWELKKDVYVVELDWYPDAPGEMVVLTCDTPEEDGITWTLDQ
       SSEVLGSGKTLTIQVKEFGDAGQYTCHKGGEVLSHSLLLLHKKEDGIWSTDILKDQK
       EPKNKTFLRCEAKNYSGRFTCWWLTTISTDLTFSVKSSRGSSDPQGVTCGAATLSAE
       RVRGDNKEYEYSVECQEDSACPAAEESLPIEVMVDAVHKLKYENYTSSFFIRDIIKP
       DPPKNLQLKPLKNSRQVEVSWEYPDTWSTPHSYFSLTFSVQVQGKDNTEGRVFTDKT
       SATVICRKNASISVRAQDRYYSSSWSEWASVPCSGGGGSGGGGSGGGGSRNLPVATP
       DPGMFPCLHHSQNLLRAVSNMLQKARQTLEFYPCTSEEIDHEDITKDKTSTVEACLP
       LELTKNESCLNSRETSFITNGSCLASRKTSFMMALCLSSIYEDLKMYQVEFKTMNAK
       LLMDPKRQIFLDQNMLAVIDELMQALNFNSETVPQKSSLEEPDFYKTKIKLCILLHA
       FRIRAVTIDRVMSYLNAS (SEQ ID NO: 181)

AK668  1<sup>st</sup> polypeptide cnain
       DKTHTCPPCPAPELLGGPSVFLFPPKPKDTLMISRTPEVTCVVVDVSHEDPEVKFNW
       YVDGVEVHNAKTKPREEQYASTYRVVSVLTVLHQDWLNGKEYKCKVSNKALPAPIEK
       TISKAKGQPREPQVCTLPPSRDELTKNQVSLSCAVKGFYPSDIAVEWESNGQPENNY
       KTTPPVLDSDGSFFLVSKLTVDKSRWQQGNVFSCSVMHEALHNHYTQKSLSLSPGGG
       SPGKIDACKRGDVTVKPSHVILLGSTVNITCSLKPRQGCFHYSRRNKLILYKFDRRI
       NFHHGHSLNSQVTGLPLGTTLFVCKLACINSDEIQICGAEIFVGVAPEQPQNLSCIQ
       KGEQGTVACTWERGRDTHLYTEYTLQLSGPKNLTWQKQCKDIYCDYLDFGINLTPES
       PESNFTAKVTAVNSLGSSSSLPSTFTFLDIVRPLPPWDIRIKFQKASVSRSTLYWRD
       EGLVLLNRLRYRPSNSRLWNMVNVTKAKGRHDLLDLKPFTEYEFQISSKLHLYKGSW
       SDWSESLRAQTPEE (SEQ ID NO: 172)

2<sup>nd</sup> polypeptide chain
       DKTHTCPPCPAPELLGGPSVFLFPPKPKDTLMISRTPEVTCVVVDVSHEDPEVKFNW
       YVDGVEVHNAKTKPREEQYASTYRVVSVLTVLHQDWLNGKEYKCKVSNKALPAPIEK
       TISKAKGQPREPQVYTLPPCRDELTKNQVSLWCLVKGFYPSDIAVEWESNGQPENNY
       KTTPPVLDSDGSFFLYSKLTVDKSRWQQGNVFSCSVMHEALHNHYTQKSLSLSPGGG
       SGGSGGSMPYDLYHPSGPIWELKKDVYVVELDWYPDAPGEMVVLTCDTPEEDGITWT
       LDQSSEVLGSGKTLTIQVKEFGDAGQYTCHKGGEVLSHSLLLLHKKEDGIWSTDILK
       DQKEPKNKTFLRCEAKNYSGRFTCWWLTTISTDLTFSVKSSRGSSDPQGVTCGAATL
       SAERVRGDNKEYEYSVECQEDSACPAAEESLPIEVMVDAVHKLKYENYTSSFFIRDI
       IKPDPPKNLQLKPLKNSRQVEVSWEYPDTWSTPHSYFSLTFSVQVQGKDNTEGRVFT
       DKTSATVICRKNASISVRAQDRYYSSSWSEWASVPCSGGGGSGGGGSGGGGSRNLPV

```
                ATPDPGMFPCLHHSQNLLRAVSNMLQKARQTLEFYPCTSEEIDHEDITKDKTSTVEA
                CLPLELTKNESCLNSRETSFITNGSCLASRKTSFMMALCLSSIYEDLKMYQVEFKTM
                NAKLLMDPKRQIPLDQNMLAVIDELMQALNFNSETVPQKSSLEEPDFYKTKIKLCIL
                LHAFRIRAVTIDRVMSYLNAS (SEQ ID NO: 183)

AK918   1st polypeptide chain
                DKTHTCPPCPAPELLGGPSVFLFPPKPKDTLMISRTPEVTCVVVDVSHEDPEVKFNW
                YVDGVEVHNAKTKPREEQYASTYRVVSVLTVLHQDWLNGKEYKCKVSNKALPAPIEK
                TISKAKGQPREPQVCTLPPSRDELTKNQVSLSCAVKGFYPSDIAVEWESNGQPENNY
                KTTPPVLDSDGSFFLVSKLTVDKSRWQQGNVFSCSVMHEALHNHYTQKSLSLSPGPG
                GSGPKIDACKRGDVTVKPSHVILLGSTVNITCSLKPRQGCFHYSRRNKLILYKFDRR
                INFHHGHSLNSQVTGLPLGTTLFVCKLACINSDEIQICGAEIFVGVAPEQPQNLSCI
                QKGEQGTVACTWERGRDTHLYTEYTLQLSGPKNLTWQKQCKDIYCDYLDFGINLTPE
                SPESNFTAKVTAVNSLGSSSSLPSTFTFLDIVRPLPPWDIRIKFQKASVSRSTLYWR
                DEGLVLLNRLRYRPSNSRLWNMVNVTKAKGRHDLLDLKPFTEYEFQISSKLHLYKGS
                WSDWSESLRAQTPEE (SEQ ID NO: 178)

2nd polypeptide chain
                DKTHTCFPCPAPELLGGPSVFLFPPKPKDTLMISRTPEVTCVWDVSHEDPEVKFNWY
                VDGVEVHNAKTKPREEQYASTYRVVSVLTVLHQDWLNGKEYKCKVSNKALPAPIEKT
                ISKAKGQPREPQVYTLPPCRDELTKNQVSLWCLVKGFYPSDIAVEWESNGQPENNYK
                TTPPVLDSDGSFFLYSKLTVDKSRWQQGNVFSCSVMHEALHNHYTQKSLSLSPGGGS
                GGSDGGFMLTSGPIWELKKDVYVVELDWYPDAPGEWVLTCDTPEEDGITWTLDQSS
                EVLGSGKTLTIQVKEFGDAGQYTCHKGGEVLSHSLLLLHKKEDGIWSTDILKDQKEP
                KNKTFLRCEAKNYSGRFTCWWLTTISTDLTFSVKSSRGSSDPQGVTCGAATLSAERV
                RGDNKEYEYSVECQEDSACPAAEESLPIEVMVDAVHKLKYENYTSSFFIRDIIKPDP
                PKNLQLKPLKNSRQVEVSWEYPDTWSTPHSYFSLTFSVQVQGKDNTEGRVFTDKTSA
                TVICRKNASISVRAQDRYYSSSWSEWASVPCSGGGGSGGGGSGGGGSRNLPVATPDP
                GMFPCLHHSQNLLRAVSNMLQKARQTLEFYPCTSEEIDHEDITKDKTSTVEACLPLE
                LTKNESCLNSRETSFITNGSCLASRKTSFMMALCLSSIYEDLKMYQVEFKTMNAKLL
                MDPKRQIFLDQNMLAVIDELMQALNFNSETVPQKSSLEEPDFYKTKIKLCILLHAFR
                IRAVTIDRVMSYLNAS (SEQ ID NO: 185)

AK919   1st polypeptide chain
                DKTHTCPPCPAPELLGGPSVFLFPPKPKDTLMISRTPEVTCVWDVSHEDPEVKFNWY
                VDGVEVHNAKTKPREEQYASTYRVVSVLTVLHQDWLNGKEYKCKVSNKALPAPIEKT
                ISKAKGQPREPQVCTLPPSRDELTKNQVSLSCAVKGFYPSDIAVEWESNGQPENNYK
                TTPPVLDSDGSFFLVSKLTVDKSRWQQGNVFSCSVMHEALHNHYTQKSLSLSPGGGS
                PGKIDACKRGDVTVKPSHVILLGSTVNITCSLKPRQGCFHYSRRNKLILYKFDRRIN
                FHHGHSLNSQVTGLPLGTTLFVCKLACINSDEIQICGAEIFVGVAPEQPQNLSCIQK
                GEQGTVACTWERGRDTHLYTEYTLQLSGPKNLTWQKQCKDIYCDYLDFGINLTPESP
                ESNFTAKVTAVNSLGSSSSLPSTFTFLDIVRPLPPWDIRIKFQKASVSRSTLYWRDE
                GLVLLNRLRYRPSNSRLWNMVNVTKAKGRHDLLDLKPFTEYEFQISSKLHLYKGSWS
                DWSESLRAQTPEE (SEQ ID NO: 172)

2nd polypeptide chain
                DKTHTCPPCPAPELLGGPSVFLFPPKPKDTLMISRTPEVTCVVVDVSHEDPEVKFNW
                YVDGVEVHNAKTKPREEQYASTYRVVSVLTVLHQDWLNGKEYKCKVSNKALPAPIEK
                TISKAKGQPREPQVYTLPPCRDELTKNQVSLWCLVKGFYPSDIAVEWESNGQPENNY
                KTTPPVLDSDGSFFLYSKLTVDKSRWQQGNVFSCSVMHEALHNHYTQKSLSLSPGGG
                SGGSGGSDSGGFMLTSGPIWELKKDVYVVELDWYPDAPGEMVVLTCDTPEEDGITWT
                LDQSSEVLGSGKTLTIQVKEFGDAGQYTCHKGGEVLSHSLLLLHKKEDGIWSTDILK
                DQKEPKNKTFLRCEAKNYSGRFTCWWLTTISTDLTFSVKSSRGSSDPQGVTCGAATL
                SAERVRGDNKEYEYSVECQEDSACPAAEESLPIEVMVDAVHKLKYENYTSSFFIRDI
                IKPDPPKNLQLKPLKNSRQVEVSWEYPDTWSTPHSYFSLTFSVQVQGKDNTEGRVFT
                DKTSATVICRKNASISVRAQDRYYSSSWSEWASVPCSGGGGSGGGGSGGGGSRNLPV
                ATPDPGMFPCLHHSQNLLRAVSNMLQKARQTLEFYPCTSEEIDHEDITKDKTSTVEA
                CLPLELTKNESCLNSRETSFITNGSCLASRKTSFMMALCLSSIYEDLKMYQVEFKTM
                NAKLLMDPKRQIFLDQNMLAVIDELMQALNFNSETVPQKSSLEEPDFYKTKIKLCIL
                LHAFRIRAVTIDRVMSYLNAS (SEQ ID NO: 187)

AK920   1st polypeptide chain
                DETHTCPPCPAPELLGGPSVFLFPPKPKDTLMISRTPEVTCVVVDVSHEDPEVKFNW
                YVDGVEVHNAKTKPREEQYASTYRVVSVLTVLHQDWLNGKEYKCKVSNKALPAPIEK
                TISKAKGQPREPQVCTLPPSRDELTKNQVSLSCAVKGFYPSDIAVEWESNGQPENNY
                KTTPPVLDSDGSFFLVSKLTVDKSRWQQGNVFSCSVMHEALHNHYTQKSLSLSPGPG
                GSGPKIDACKRGDVTVKPSHVILLGSTVNITCSLKPRQGCFHYSRRNKLILYKFDRR
                INFHHGHSLNSQVTGLPLGTTLFVCKLACINSDEIQICGAEIFVGVAPEQPQNLSCI
                QKGEQGTVACTWERGRDTHLYTEYTLQLSGPKNLTWQKQCKDIYCDYLDFGINLTPE
                SPESNFTAKVTAVNSLGSSSSLPSTFTFLDIVRPLPPWDIRIKFQKASVSRSTLYWR
                DEGLVLLNRLRYRPSNSRLWNMVNVTKAKGRHDLLDLKPFTEYEFQISSKLHLYKGS
                WSDWSESLRAQTPEE (SEQ ID NO: 178)

2nd polypeptide chain
                DKTHTCPPCPAPELLGGPSVFLFPPKPKDTLMISRTPEVTCVVVDVSHEDPEVKFNW
                YVDGVEVHNAKTKPREEQYASTYRVVSVLTVLHQDWLNGKEYKCKVSNKALPAPIEK
                TISKAKGQPREPQVYTLPPCRDELTKNQVSLWCLVKGFYPSDIAVEWESNGQPENNY
                KTTPPVLDSDGSFFLYSKLTVDKSRWQQGNVFSCSVMHEALHNHYTQKSLSLSPGGG
                SGGSRAAAVKSPSGPIWELKKDVYVVELDWYPDAPGEMVVLTCDTPEEDGITWTLDQ
```

SSEVLGSGKTLTIQVKEFGDAGQYTCHKGGEVLSHSLLLLHKKEDGIWSTDILKDQK
EPKNKTFLRCEAKNYSGRFTCWWLTTISTDLTFSVKSSRGSSDPQGVTCGAATLSAE
RVRGDNKEYEYSVECQEDSACPAAEESLPIEVMVDAVHKLKYENYTSSFFIRDIIKP
DPPKNLQLKPLKNSRQVEVSWEYPDTWSTPHSYFSLTFSVQVQGKDNTEGRVFTDKT
SATVICRKNASISVRAQDRYYSSSWSEWASVPCSGGGGSGGGGSGGGGSRNLPVATP
DPGMFPCLHHSQNLLRAVSNMLQKARQTLEFYPCTSEEIDHEDITKDKTSTVEACLP
LELTKNESCLNSRETSFITNGSCLASRKTSFMMALCLSSIYEDLKMYQVEFKTMNAK
LLMDPKRQIELDQNMLAVIDELMQALNFNSETVPQKSSLEEPDFYKTKIKLCILLHA
FRIRAVTIDRVMSYLNAS (SEQ ID NO: 189)

AK921 1st polypeptide chain
DKTHTCPPCPAPELLGGPSVFLFPPKPKDTLMISRTPEVTCVVVDVSHEDPEVKFNW
YVDGVEVHNAKTKPREEQYASTYRVVSVLTVLHQDWLNGKEYKCKVSNKALPAPIEK
TISKAKGQPREPQVCTLPPSRDELTKNQVSLSCAVKGFYPSDIAVEWESNGQPENNY
KTTPPVLDSDGSFFLVSKLTVDKSRWQQGNVFSCSVMHEALHNHYTQKSLSLSPGGG
SPGKIDACKRGDVTVKPSHVILLGSTVNITCSLKPRQGCFHYSRRNKLILYKFDRRI
NFHHGHSLNSQVTGLPLGTTLFVCKLACINSDEIQICGAEIFVGVAPEQPQNLSCIQ
KGEQGTVACTWERGRDTHLYTEYTLQLSGPKNLTWQKQCKDIYCDYLDFGINLTPES
PESNFTAKVTAVNSLGSSSLPSTFTFLDIVRPLPPWDIRIKFQKASVSRSTLYWRD
EGLVLLNRLRYRPSNSRLWNMVNVTKAKGRHDLLDLKPFTEYEFQISSKLHLYKGSW
SDWSESLRAQTPEE (SEQ ID NO: 172)

2nd polypeptide chain
DKTHTCPPCPAPELLGGPSVFLFPPKPKDTLMISRTPEVTCVVVDVSHEDPEVKFNW
YVDGVEVHNAKTKPREEQYASTYRVVSVLTVLHQDWLNGKEYKCKVSNKALPAPIEK
TISKAKGQPREPQVYTLPPCRDELTKNQVSLWCLVKGFYPSDIAVEWESNGQPENNY
KTTPPVLDSDGSFFLYSKLTVDKSRWQQGNVFSCSVMHEALHNHYTQKSLSLSPGGG
SGGSGGSRAAAVKSPSGPIWELKKDVYVVELDWYPDAPGEMVVLTCDTPEEDGITWT
LDQSSEVLGSGKTLTIQVKEFGDAGQYTCHKGGEVLSHSLLLLHKKEDGIWSTDILK
DQKEPKNKTFLRCEAKNYSGRFTCWWLTTISTDLTFSVKSSRGSSDPQGVTCGAATL
SAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFSVQVQGKDNTEGRVFT
DKTSATVICRKNASISVRAQDRYYSSSWSEWASVPCSGGGGSGGGGSGGGGSRNLPV
ATPDPGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTM
NAKLLMDPKRQIFLDQNMLAVIDELMQALNFNSETVPQKSSLEEPDFYKTKIKLCIL
LHAFRIRAVTIDRVMSYLNAS (SEQ ID NO: 191)

AK922 1st polypeptide chain
DKTHTCPPCPAPELLGGPSVELEPPKPKDTLMISRTPEVTCVVVDVSHEDPEVKFNW
YVDGVEVHNAKTEPREEQYASTYRVVSVLTVLHQDWLNGKEYKCKVSNKALPAPIEK
TISKAKGQPREPQVCTLPPSRDELTKNQVSLSCAVKGFYPSDIAVEWESNGQPENNY
KTTPPVLDSDGSFFLVSKLTVDKSRWQQGNVFSCSVMHEALHNHYTQKSLSLSPGGG
SGGGSGKIDACKRGDVTVKPSHVILLGSTVNITCSLKPRQGCFHYSRRNKLILYKFD
RRINFHHGHSLNSQVTGLPLGTTLFVCKLACINSDEIQICGAEIFVGVAPEQPQNLS
CIQKGEQGTVACTWERGRDTHLYTEYTLQLSGPKNLTWQKQCKDIYCDYLDFGINLT
PESPESNFTAKVTAVNSLGSSSLPSTFTFLDIVRPLPPWDIRIKFQKASVSRSTLY
WRDEGLVLLNRLRYRPSNSRLWNMVNVTKAKGRHDLLDLKPFTEYEFQISSKLHLYK
GSWSDWSESLRAQTPEE (SEQ ID NO: 192)

2nd polypeptide chain
DKTHTCPPCPAPELLGGPSVFLFPPKPKDTLMISRTPEVTCVVVDVSHEDPEVKFNW
YVDGVEVHNAKTEPREEQYASTYRVVSVLTVLHQDWLNGKEYKCKVSNKALPAPIEK
TISKAKGQPREPQVYTLPPCRDELTKNQVSLWCLVKGFYPSDIAVEWESNGQPENNY
KTTPPVLDSDGSFFLYSKLTVDKSRWQQGNVFSCSVMHEALHNHYTQKSLSLSPGGG
SGGSISSGLLSGRSSGPIWELKKDVYVVELDWYPDAPGEMVVLTCDTPEEDGITWTL
DQSSEVLGSGKTLTIQVKEFGDAGQYTCHKGGEVLSHSLLLLHKKEDGIWSTDILKD
QKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDII
KPDPPKNLQLKPLKNSRQVEVSWEYPDTWSTPHSYFSLTFSVQVQGKDNTEGRVFTD
KTSATVICRKNASISVRAQDRYYSSSWSEWASVPCSGGGGSGGGGSGGGGSRNLPVA
TPDPGMFPCLHHSQNLLRAVSNMLQKARQTLEFYPCTSEEIDHEDITKDKTSTVEAC
LPLELTKNESCLNSRETSFITNGSCLASRKTSFMMALCLSSIYEDLKMYQVEFKTMN
AKLLMDPKRQIFLDQNMLAVIDELMQALNFNSETVPQKSSLEEPDFYKTKIKLCILL
HAFRIRAVTIDRVMSYLNAS (SEQ ID NO: 193)

-continued

```
AK923  1st polypeptide chain
       DKTHTCPPCFAPELLGGPSVFLFPPKPKDTLMISRTPEVTCVVVDVSHEDPEVKFNW
       YVDGVEVHNAKTKPREEQYASTYRVVSVLTVLHQDWLNGKEYKCKVSNKALPAPIEK
       TISKAKGQPREPQVCTLPPSRDELTKNQVSLSCAVKGFYPSDIAVEWESNGQPENNY
       KTTPPVLDSDGSFFLVSKLTVDKSRWQQGNVFSCSVMHEALHNHYTQKSLSLSPGGG
       SGGGSGKIDACKRGDVTVKPSHVILLGSTVNITCSLKPRQGCFHYSRRNKLILYKFD
       RRINFHHGHSLNSQVTGLPLGTTLFVCKLACINSDEIQICGAEIFVGVAPEQPQNLS
       CIQKGEQGTVACTWERGRDTHLYTEYTLQLSGPKNLTWQKQCKDIYCDYLDFGINLT
       PESPESNFTAKVTAVNSLGSSSSLPSTFTFLDIVRPLPPWDIRIKFQKASVSRSTLY
       WRDEGLVLLNRLRYRPSNSRLWNMVNVTKAKGRHDLLDLKPFTEYEFQISSKLHLYK
       GSWSDWSESLRAQTPEE (SEQ ID NO: 192)

2nd polypeptide chain
       DKTHTCPPCPAPELLGGPSVFLFPPKPKDTLMISRTPEVTCVVVDVSHEDPEVKFNW
       YVDGVEVHNAKTKPREEQYASTYRVVSVLTVLHQDWLNGKEYKCKVSNKALPAPIEK
       TISKAKGQPREPQVYTLPPCRDELTKNQVSLWCLVKGFYPSDIAVEWESNGQPENNY
       KTTPPVLDSDGSFFLYSKLTVDKSRWQQGNVFSCSVMHEALHNHYTQKSLSLSPGGG
       SGGSGGSISSGLLSGRSSGPIWELKKDVYVVELDWYPDAPGEMVVLTCDTPEEDGIT
       WTLDQSSEVLGSGKTLTIQVKEFGDAGQYTCHKGGEVLSHSLLLLHKKEDGIWSTDI
       LKDQKEPKNKTFLRCEAKNYSGRFTCWWLTTISTDLTFSVKSSRGSSDPQGVTCGAA
       TLSAERVRGDNKEYEYSVECQEDSACPAAEESLPIEVMVDAVHKLKYENYTSSFFIR
       DIIKPDPPKNLQLKPLKNSRQVEVSWEYPDTWSTPHSYFSLTFSVQVQGKDNTEGRV
       FTDKTSATVICRKNASISVRAQDRYYSSSWSEWASVPCSGGGGSGGGGSGGGGSRNL
       PVATPDPGMFPCLHHSQNLLRAVSNMLQKARQTLEFYPCTSEEIDHEDITKDKTSTV
       EACLPLELTKNESCLNSRETSFITNGSCLASRKTSFMMALCLSSIYEDLKMYQVEFK
       TMNAKLLMDPKRQIFLDQNMLAVIDELMQALNFNSETVPQKSSLEEPDFYKTKIKLC
       ILLHAFRIRAVTIDRVMSYLNAS (SEQ ID NO: 195)

AK924  1st polypeptide chain
       DKTHTCPPCPAPELLGGPSVFLFPPKPKDTLMISRTPEVTCVVVDVSHEDPEVKFNW
       YVDGVEVHNAKTKPREEQYASTYRVVSVLTVLHQDWLNGKEYKCKVSNKALPAPIEK
       TISKAKGQPREPQVCTLPPSRDELTKNQVSLSCAVKGFYPSDIAVEWESNGQPENNY
       KTTPPVLDSDGSFFLVSKLTVDKSRWQQGNVFSCSVMHEALHNHYTQKSLSLSPGGG
       SGGGSGKIDACKRGDVTVKPSHVILLGSTVNITCSLKPRQGCFHYSRRNKLILYKFD
       RRINFHHGHSLNSQVTGLPLGTTLFVCKLACINSDEIQICGAEIFVGVAPEQPQNLS
       CIQKGEQGTVACTWERGRDTHLYTEYTLQLSGPRNLTWQKQCKDIYCDYLDFGINLT
       PESPESNFTAKVTAVNSLGSSSSLPSTFTFLDIVRPLPPWDIRIKFQKASVSRSTLY
       WRDEGLVLLNRLRYRPSNSRLWNMVNVTKAKGRHDLLDLKPFTEYEFQISSKLHLYK
       GSWSDWSESLRAQTPEE (SEQ ID NO: 192)

2nd polypeptide chain
       DKTHTCPPCPAPELLGGPSVFLFPPKPKDTLMISRTPEVTCVVVDVSHEDPEVKFNW
       YVDGVEVHNAKTKPREEQYASTYRVVSVLTVLHQDWLNGKEYKCKVSNKALPAPIEK
       TISKAKGQPREPQVYTLPPCRDELTKNQVSLWCLVKGFYPSDIAVEWESNGQPENNY
       KTTPPVLDSDGSFFLYSKLTVDKSRWQQGNVFSCSVMHEALHNHYTQKSLSLSPGGG
       SGGSRAAAVKSPSGPIWELKKDVYVVELDWYPDAPGEMVVLTCDTPEEDGITWTLDQ
       SSEVLGSGKTLTIQVKEFGDAGQYTCHKGGEVLSHSLLLLHKKEDGIWSTDILKDQK
       EPKNKTFLRCEAKNYSGRFTCWWLTTISTDLTFSVKSSRGSSDPQGVTCGAATLSAE
       RVRGDNKEYEYSVECQEDSACPAAEESLPIEVMVDAVHKLKYENYTSSFFIRDIIKP
       DPPKNLQLKPLKNSRQVEVSWEYPDTWSTPHSYFSLTFSVQVQGKDNTEGRVFTDKT
       SATVICRKNASISVRAQDRYYSSSWSEWASVPCSGGGGSGGGGSGGGGSRNLPVATP
       DPGMFPCLHHSQNLLRAVSNMLQKARQTLEFYPCTSEEIDHEDITKDKTSTVEACLP
       LELTKNESCLNSRETSFITNGSCLASRKTSFMMALCLSSIYEDLKMYQVEFKTMNAK
       LLMDPKRQIFLDQNMLAVIDELMQALNFNSETVPQKSSLEEPDFYKTKIKLCILLHA
       FRIRAVTIDRVMSYLNAS (SEQ ID NO: 189)

AK925  1st polypeptide chain
       DKTHTCPPCPAPELLGGPSVFLFPPKPKDTLMISRTPEVTCVVVDVSHEDPEVKFNW
       YVDGVEVHNAKTKPREEQYASTYRVVSVLTVLHQDWLNGKEYKCKVSNKALPAPIEK
       TISKAKGQPREPQVCTLPPSRDELTKNQVSLSCAVKGFYPSDIAVEWESNGQPENNY
       KTTPPVLDSDGSFFLVSKLTVDKSRWQQGNVFSCSVMHEALHNHYTQKSLSLSPGGG
       SGGGSGKIDACKRGDVTVKPSHVILLGSTVNITCSLKPRQGCFHYSRRNKLILYKFD
       RRINFHHGHSLNSQVTGLPLGTTLFVCKLACINSDEIQICGAEIFVGVAPEQPQNLS
       CIQKGEQGTVACTWERGRDTHLYTEYTLQLSGPKNLTWQKQCKDIYCDYLDFGINLT
       PESPESNFTAKVTAVNSLGSSSSLPSTFTFLDIVRPLPPWDIRIKFQKASVSRSTLY
       WRDEGLVLLNRLRYRPSNSRLWNMVNVTKAKGRHDLLDLKPFTEYEFQISSKLHLYK
       GSWSDWSESLRAQTPEE (SEQ ID NO: 192)

2nd polypeptide chain
       DKTHTCPPCPAPELLGGPSVFLFPPKPKDTLMISRTPEVTCVVVDVSHEDPEVKFNW
       YVDGVEVHNAKTKPREEQYASTYRVVSVLTVLHQDWLNGKEYKCKVSNKALPAPIEK
       TISKAKGQPREPQVYTLPPCRDELTKNQVSLWCLVKGFYPSDIAVEWESNGQPENNY
       KTTPPVLDSDGSFFLYSKLTVDKSRWQQGNVFSCSVMHEALHNHYTQKSLSLSPGGG
       SGGSGGSRAAAVKSPSGPIWELKKDVYVVELDWYPDAPGEMVVLTCDTPEEDGITWT
       LDQSSEVLGSGKTLTIQVKEFGDAGQYTCHKGGEVLSHSLLLLHKKEDGIWSTDILK
       DQKEPKNKTFLRCEAKNYSGRFTCWWLTTISTDLTFSVKSSRGSSDPQGVTCGAATL
       SAERVRGDNKEYEYSVECQEDSACPAAEESLPIEVMVDAVHKLKYENYTSSFFIRDI
       IKPDPPKNLQLKPLKNSRQVEVSWEYPDTWSTPHSYFSLTFSVQVQGKDNTEGRVFT
       DKTSATVICRKNASISVRAQDRYYSSSWSEWASVPCSGGGGSGGGGSGGGGSRNLPV
```

-continued

```
              ATPDPGMFPCLHHSQNLLRAVSNMLQKARQTLEFYPCTSEEIDHEDITKDKTSTVEA
              CLPLELTKNESCLNSRETSFITNGSCLASRKTSFMMALCLSSIYEDLKMYQVEFKTM
              NAKLLMDPKRQIFLDQNMLAVIDELMQALNFNSETVPQKSSLEEPDFYKTKIKLCIL
              LHAFRIRAVTIDRVMSYLNAS (SEQ ID NO: 191)

AK669   1st polypeptide chain
              DKTHTCPPCPAPELLGGPSVFLFPPKPKDTLMISRTPEVTCVVVDVSHEDPEVKFNW
              YVDGVEVHNAETKPREEQYASTYRVVSVLTVLHQDWLNGKEYKCKVSNKALPAPIEK
              TISKARGQPREPQVCTLPPSRDELTKNQVSLSCAVKGFYPSDIAVEWESNGQPENNY
              KTTPPVLDSDGSFFLVSKLTVDKSRWQQGNVFSCSVMHEALHNHYTQKSLSLSPGPG
              GSGPKIDACKRGDVTVKPSHVILLGSTVNITCSLKPRQGCFHYSRRNKLILYKFDRR
              INFHHGHSLNSQVTGLPLGTTLFVCKLACINSDEIQICGAEIFVGVAPEQPQNLSCI
              QKGEQGTVACTWERGRDTHLYTEYTLQLSGPKNLTWQKQCKDIYCDYLDFGINLTPE
              SPESNFTAKVTAVNSLGSSSSLPSTFTFLDIVRPLPPWDIRIKFQKASVSRSTLYWR
              DEGLVLLNRLRYRPSNSRLWNMVNVTKAKGRHDLLDLKPFTEYEFQISSKLHLYKGS
              WSDWSESLRAQTPEE (SEQ ID NO: 178)

2nd polypeptide chain
              DKTHTCPPCPAPELLGGPSVFLFPPKPKDTLMISRTPEVTCVVVDVSHEDPEVKFNW
              YVDGVEVHNAKTKPREEQYASTYRVVSVLTVLHQDWLNGKEYKCKVSNKALPAPIEK
              TISKAKGQPREPQVYTLPPCRDELTKNQVSLWCLVKGFYPSDIAVEWESNGQPENNY
              KTTPPVLDSDGSFFLYSKLTVDKSRWQQGNVFSCSVMHEALHNHYTQKSLSLSPGGG
              SGGSISSGLLSGRSSGPIWELKKDVYVVELDWYPDAPGEMVVLTCDTPEEDGITWTL
              DQSSEVLGSGKTLTIQVKEFGDAGQYTCHKGGEVLSHSLLLLHKKEDGIWSTDILKD
              QKEPKNKTFLRCEAKNYSGRFTCWWLTTISTDLTFSVKSSRGSSDPQGVTCGAATLS
              AERVRGDNKEYEYSVECQEDSACPAAEESLPIEVMVDAVHKLKYENYTSSFFIRDII
              KPDPPKNLQLKPLKNSRQVEVSWEYPDTWSTPHSYFSLTFSVQVQGKDNTEGRVFTD
              KTSATVICRKNASISVRAQDRYYSSSWSEWASVPCSGGGGSGGGGSGGGGSRNLPVA
              TPDPGMFPCLHHSQNLLRAVSNMLQKARQTLEFYPCTSEEIDHEDITKDKTSTVEAC
              LPLELTKNESCLNSRETSFITNGSCLASRKTSFMMALCLSSIYEDLKMYQVEFKTMN
              AKLLMDPKRQIFLDQNMLAVIDELMQALNFNSETVPQKSSLEEPDFYKTKIKLCILL
              HAFRIRAVTIDRVMSYLNAS (SEQ ID NO: 193)

AK670   1st polypeptide chain
              DKTHTCPPCPAPELLGGPSVFLFPPKPKDTLMISRTPEVTCVVVDVSHEDPEVKFNW
              YVDGVEVHNAKTKPREEQYASTYRVVSVLTVLHQDWLNGKEYKCKVSNKALPAPIEK
              TISKAKGQPREPQVCTLPPSRDELTKNQVSLSCAVKGFYPSDIAVEWESNGQPENNY
              KTTPPVLDSDGSFFLVSKLTVDKSRWQQGNVFSCSVMHEALHNHYTQKSLSLSPGGG
              SPGKIDACKRGDVTVKPSHVILLGSTVNITCSLKPRQGCFHYSRRNKLILYKFDRRI
              NFHHGHSLNSQVTGLPLGTTLFVCKLACINSDEIQICGAEIFVGVAPEQPQNLSCIQ
              KGEQGTVACTWERGRDTHLYTEYTLQLSGPKNLTWQKQCKDIYCDYLDFGINLTPES
              PESNFTAKVTAVNSLGSSSSLPSTFTFLDIVRPLPPWDIRIKFQKASVSRSTLYWRD
              EGLVLLNRLRYRPSNSRLWNMVNVTKAKCRHDLLDLKPFTEYEFQISSKLHLYKGSW
              SDWSESLRAQTPEE (SEQ ID NO: 172)

2nd polypeptide chain
              DKTHTCPPCPAPELLGGPSVFLFPPKPKDTLMISRTPEVTCVVVDVSHEDPEVKFNW
              YVDGVEVHNAKTKPREEQYASTYRVVSVLTVLHQDWLNGKEYKCKVSNKALPAPIEK
              TISKAKGQPREPQVYTLPPCRDELTKNQVSLWCLVKGFYPSDKAVEWESNGQPENNY
              KTTPPVLDSDGSFFLYSKLTVDKSRWQQGNVFSCSVMHEALHNHYTQKSLSLSPGGG
              SGGSGGSISSGLLSGRSSGPIWELKKDVYVVELDWYPDAPGEMVVLTCDTPEEDGITW
              TLDQSSEVLGSGKTLTIQVKEFGDAGQYTCHKGGEVLSHSLLLLHKKEDGIWSTDIL
              KDQKEPKNKTFLRCEAKNYSGRFTCWWLTTISTDLTFSVKSSRGSSDPQGVTCGAAT
              LSAERVRGDNKEYEYSVECQEDSACPAAEESLPIEVMVDAVHKLKYENYTSSFFIRD
              IIKPDPPKNLQLKPLKNSRQVEVSWEYPDTWSTPHSYFSLTFSVQVQGKDNTEGRVF
              TDKTSATVICRKNASISVRAQDRYYSSSWSEWASVPCSGGGGSGGGGSGGGGSRNLP
              VATPDPGMFPCLHHSQNLLRAVSNMLQKARQTLEFYPCTSEEIDHEDITKDKTSTVE
              ACLPLELTKNESCLNSRETSFITNGSCLASRKTSFMMALCLSSIYEDLKMYQVEFKT
              MNAKLLMDPKRQIFLDQNMLAVIDELMQALNFNSETVPQKSSLEEPDFYKTKIKLCI
              LLHAFRIRAVTIDRVMSYLNAS (SEQ ID NO: 195)
```

Figures 71A, 71B, 71C:
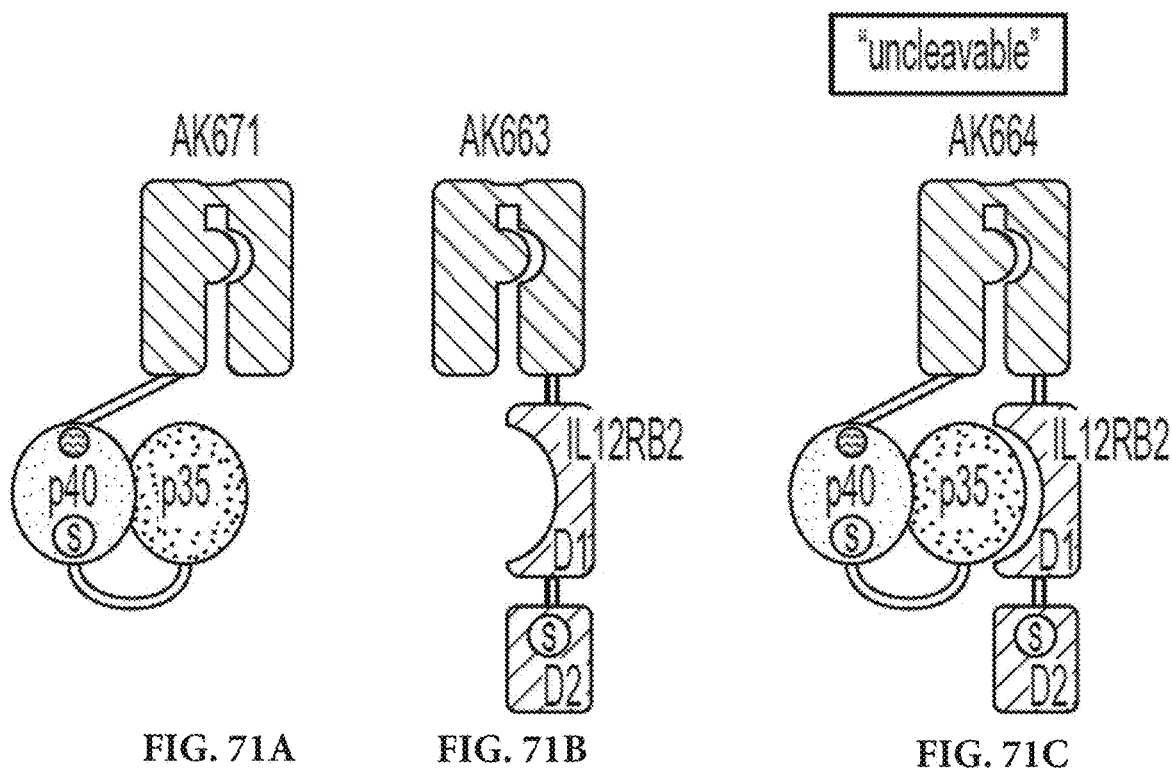
FIG. 71A-FIG. 71Q show the constructs in Example 9.
Figures 71D, 71E, 71F:
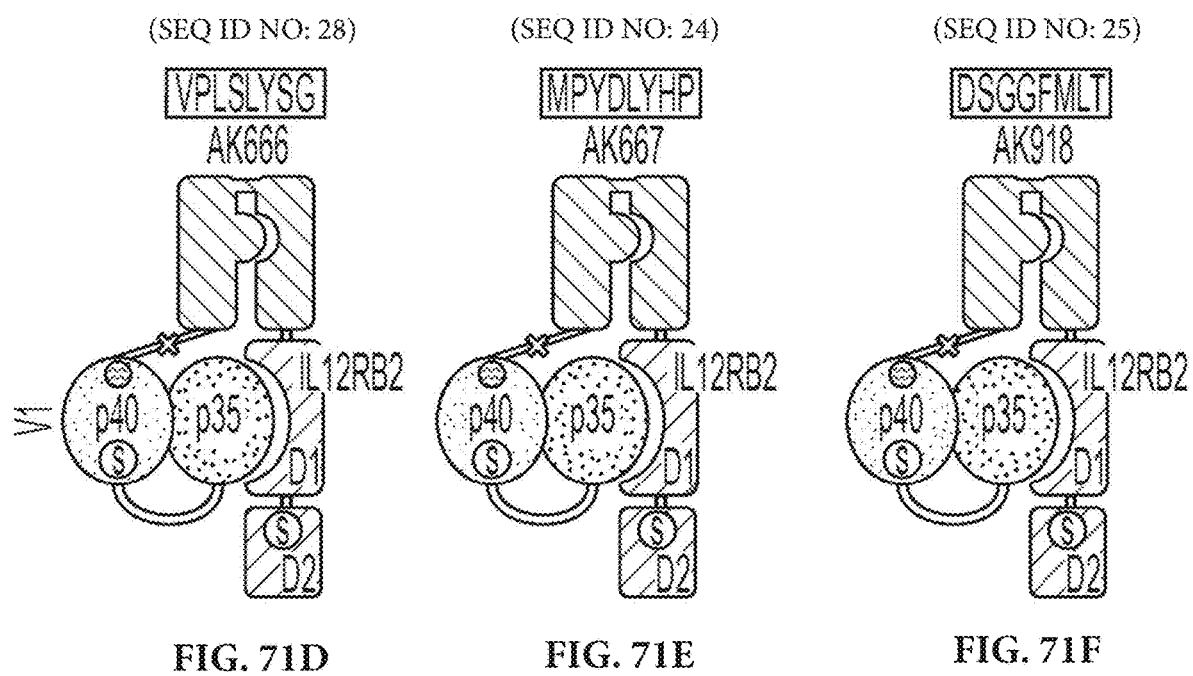

The following used in this example are shown in FIG. 71.

AK671 is an unmasked molecule, AK663 does not comprise acytokine, and AK664 is non-cleavable. These three molecules serve as controls.

The cleavage peptide for each construct is show at the top of each column.

AK666, AK667, AK918, AK920 and AK669 are 'version 1' constructs. AK665, AK668, AK919, AK921, AK670 are 'version 2' constructs. AK924, AK922, AK925 and AK923 are 'version 3' constructs. The cleavable linker (protease site linker), i.e. between the HL2 and the IL-12 domain, and the non-cleavable linker (b2 receptor linker) between HL1 and the masking moiety for each version is shown below:

| v1 | Protease site linker | | b2 receptor linker |
|----|----------------------|----|--------------------|
| V1 | GGSGGSXXXXXXSGP (SEQ ID NO: 436) | V1 | PGGSGP (SEQ ID NO: 167) |
| V2 | GGSGGSGGSXXXXXXSGP (SEQ ID NO: 437) | V2 | GGSPG (SEQ ID NO: 168) |
|    |                      | V3 | GGSGGGSG (SEQ ID NO: 169) |

Where applicable, all of these constructs comprise a KDNTEGRV (SEQ ID NO: 127) mutation to the GAG binding domain of the IL-12p40 subunit, a C252S mutation of the Il-12p40 subunit, and a C242S mutation of the IL-12RB2 domain. Sequences for each construct are shown in the table below:

i) Ex Vivo Cleavage Assay (WB/IL-12 Signalling)

1 uM of IL-12 construct were incubated with 90 ul of conditioned media overnight or 90 ul of plasma, for the following times (d1-d2-d4-d7-d9-d11) at 37C. The cleavage rate is calculated as a ratio of: cleaved construct/(cleaved construct+intact construct), using a western blot anti-human IL-12 and anti-human IL-12Rb. The activation of these constructs by human tissue conditioned media is assessed using a post-IL-12 receptor signalling assay where $0.05 \times 10^6$ HEK-Blue cells are incubated with 37.5 nM of constructs, for 24 h.

Figure 46:
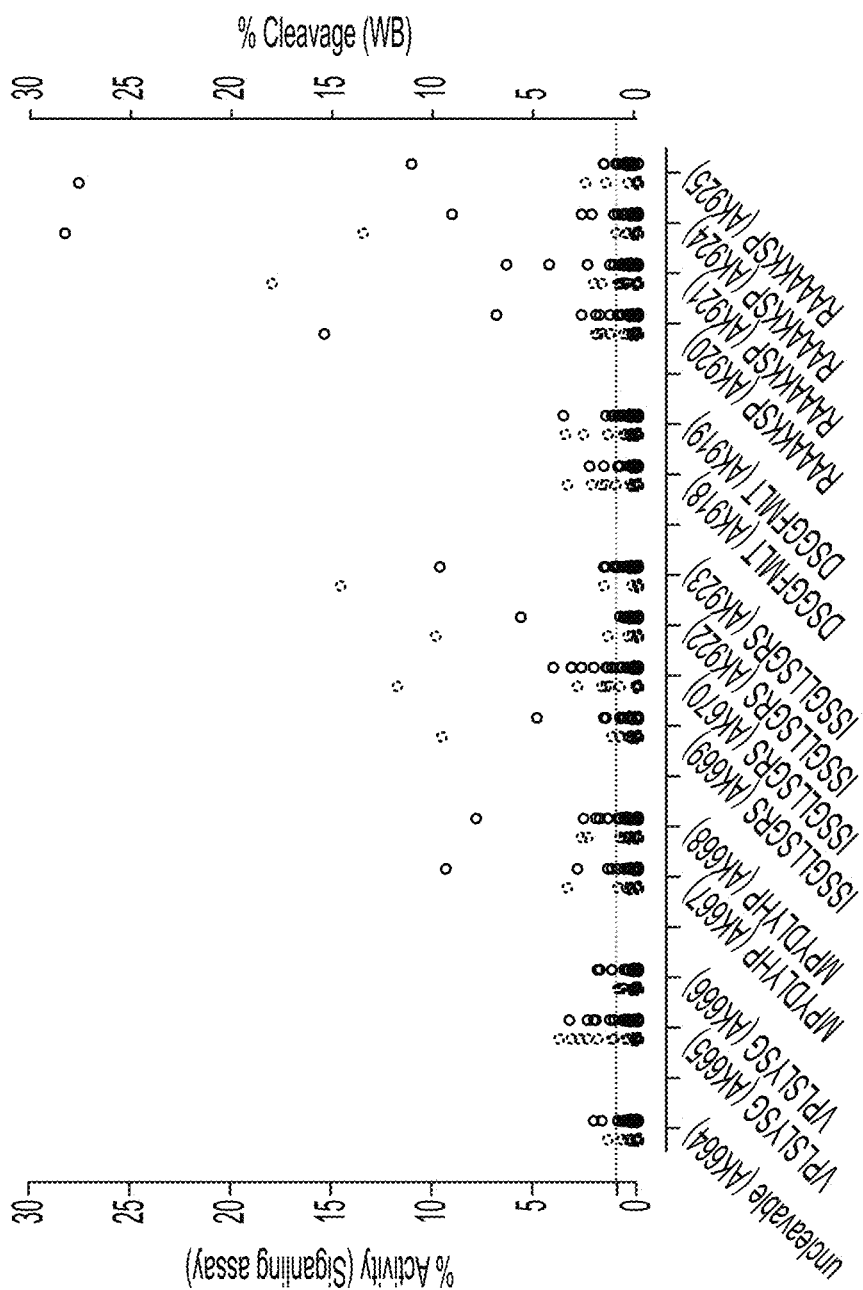
FIG. 46 discloses SEQ ID NOS 439, 439, 440, 440, 441, 441, 441, 441, 442, 442, 443, 443, 443, and 443, respectively, in order of appearance and discloses their percentage cleavage.
Figure 47:
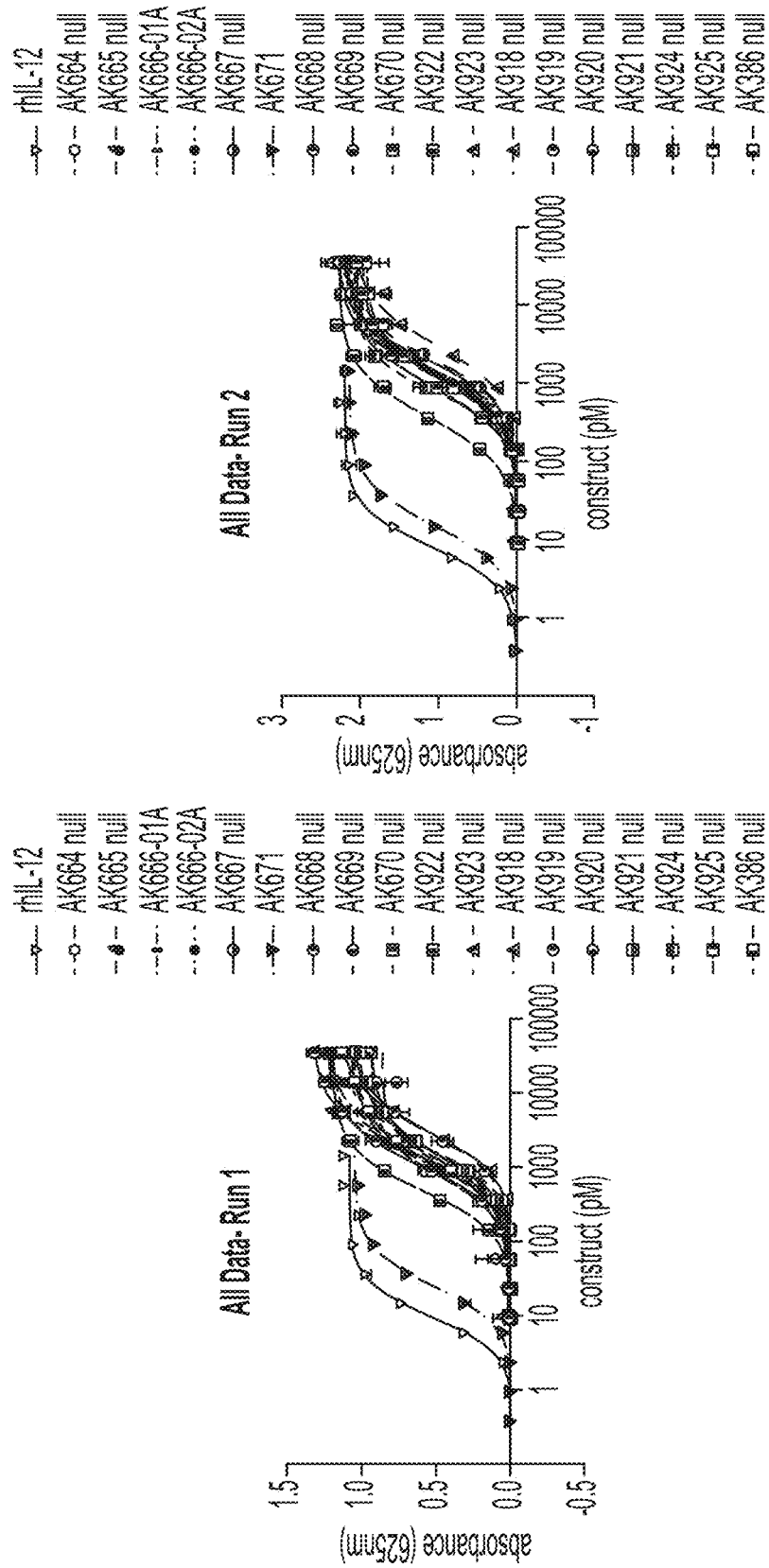
FIG. 47 shows absorbance of different constructs at 625 nm in two runs.
Figure 48A:
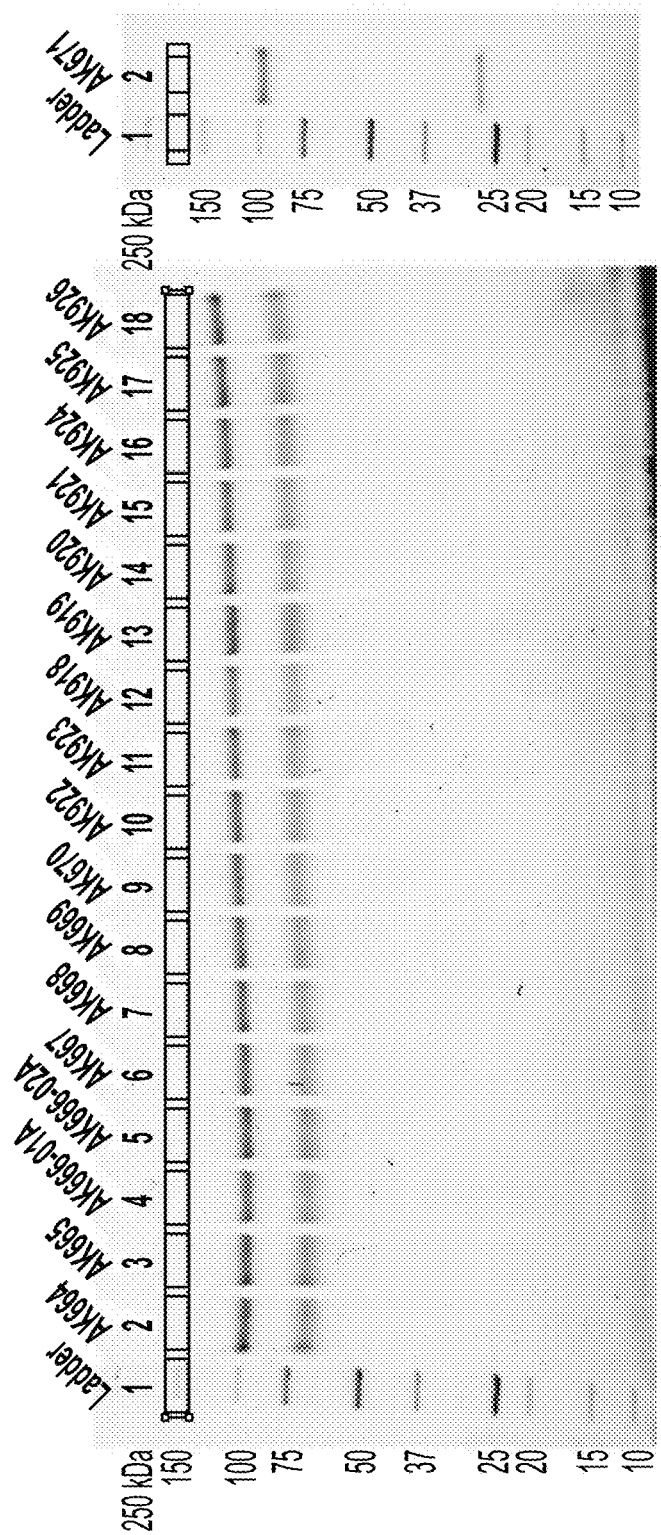
FIGS. 48A and 48B show masking of different constructs.
Figure 48B:
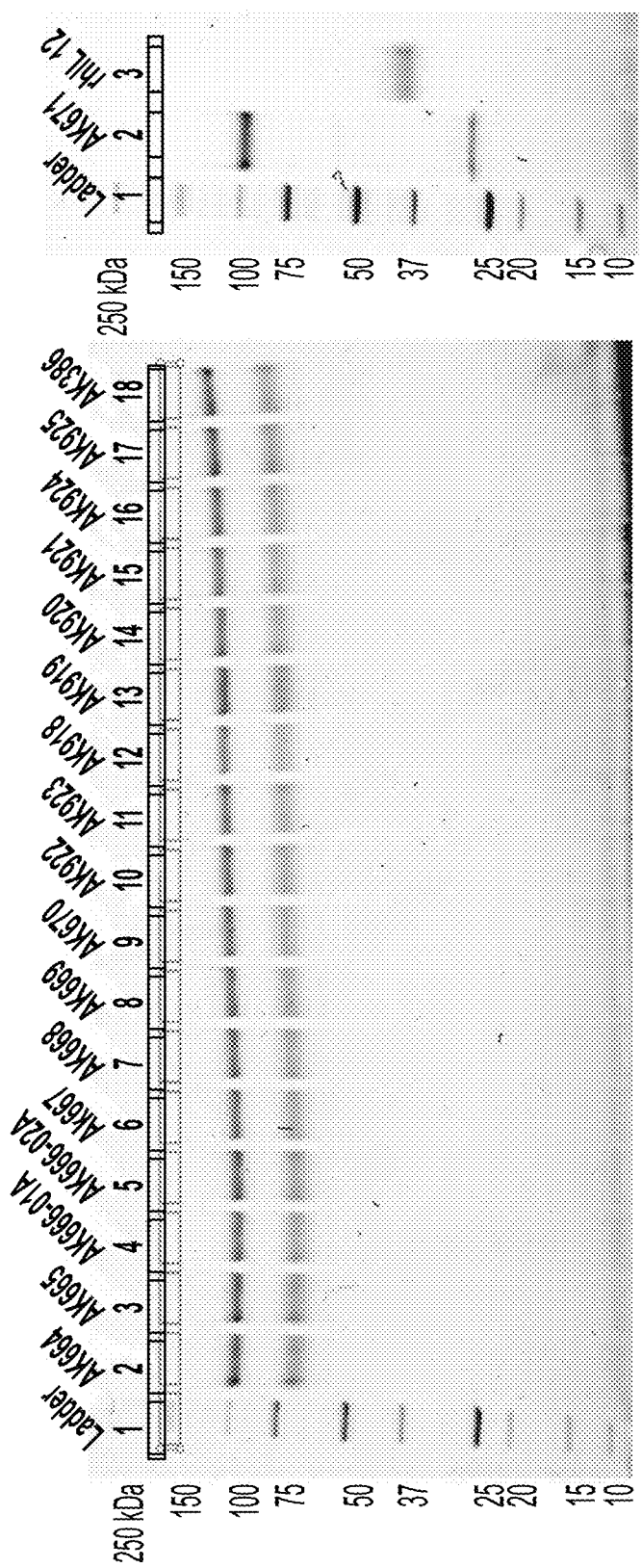
Figure 49A:
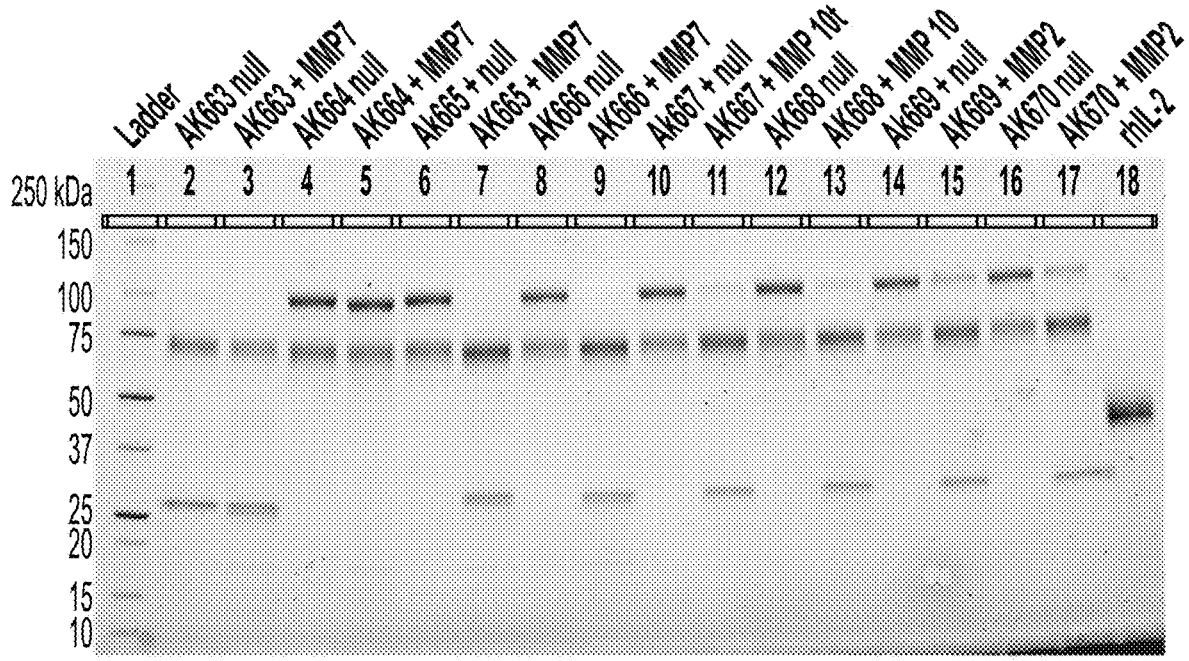
FIGS. 49A and 49B show cleavage of different constructs by MMP proteases.
Figure 49B:
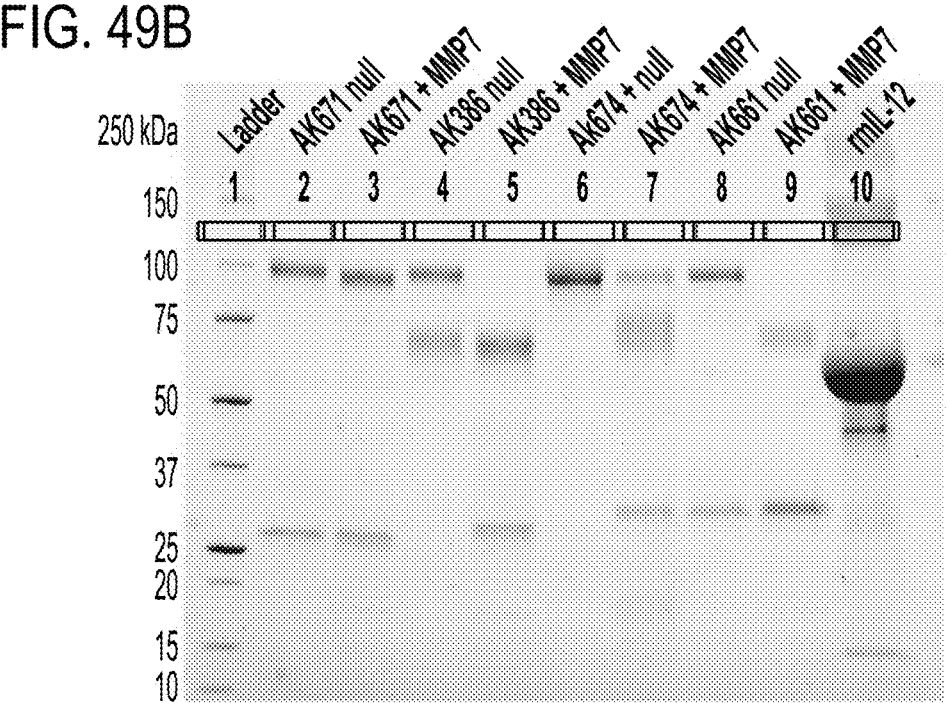
Figure 50A:
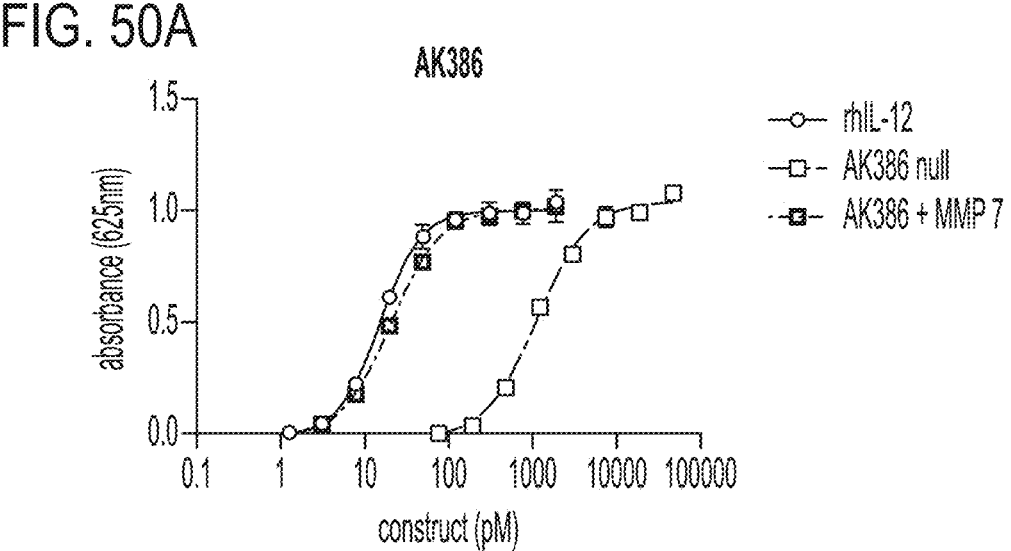
FIG. 50A shows EC50 value for AK386 construct in absence and presence of MMP 7 protease.
Figure 50B:
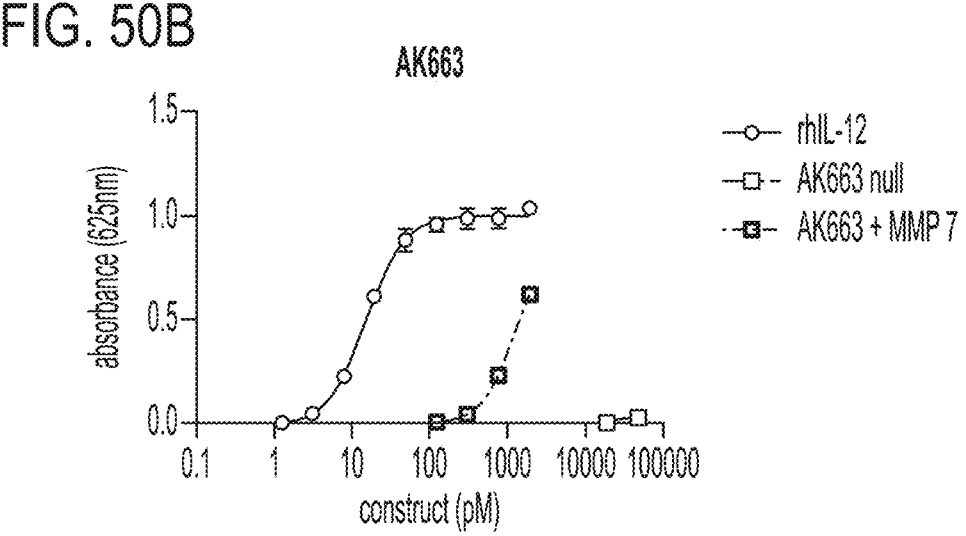
FIG. 50B shows EC50 value for AK663 construct in absence and presence of MMP 7 protease.
Figure 50C:
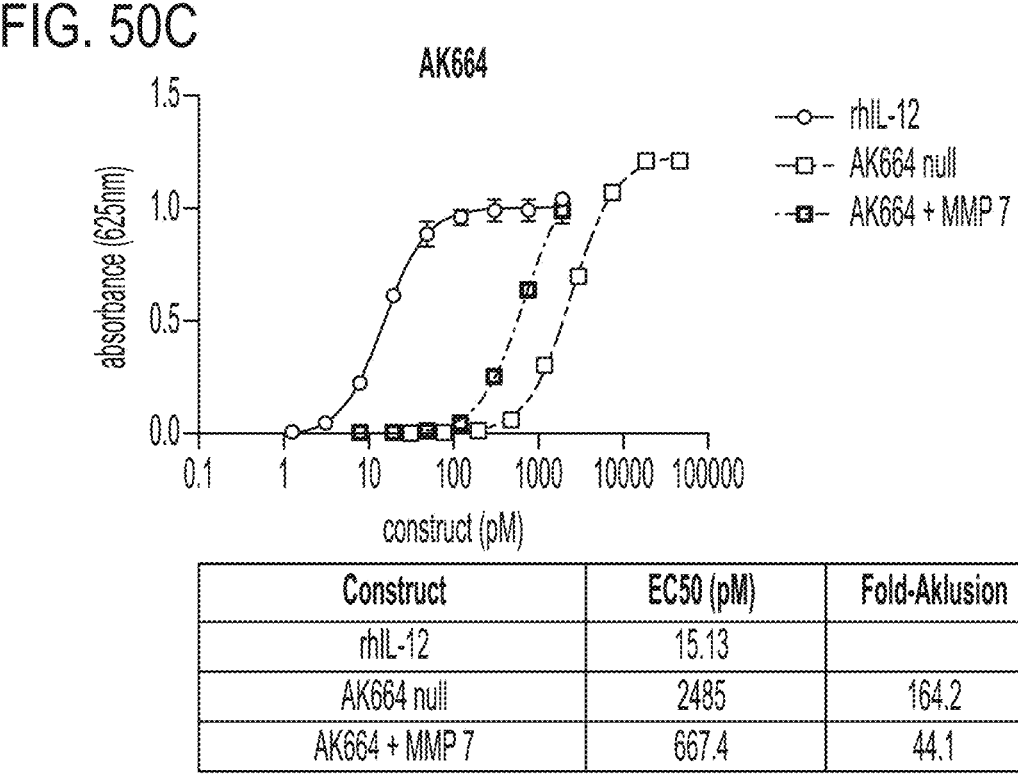
FIG. 50C shows EC50 value for AK664 construct in absence and presence of MMP 7 protease.
Figure 50D:
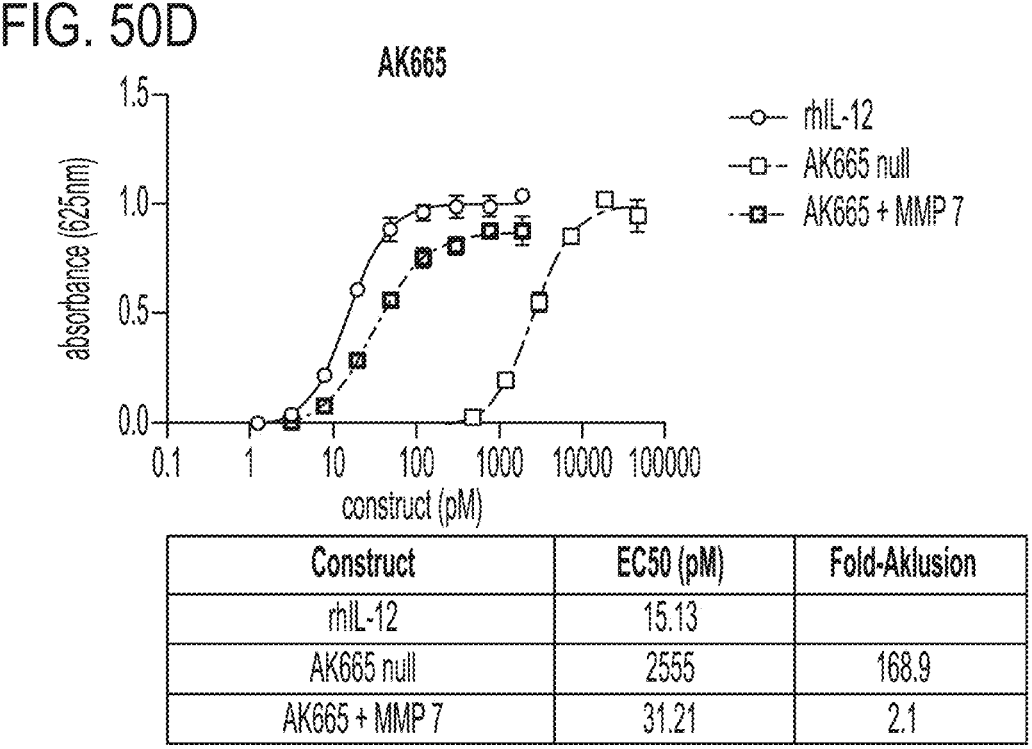
FIG. 50D shows EC50 value for AK665 construct in absence and presence of MMP 7 protease.
Figure 50E:
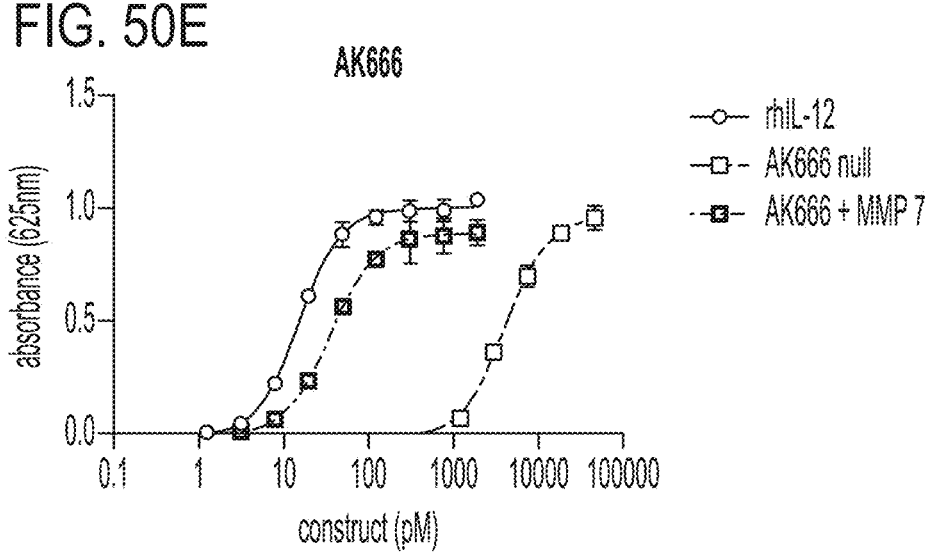
FIG. 50E shows EC50 value for AK666 construct in absence and presence of MMP 7 protease.
Figure 50F:
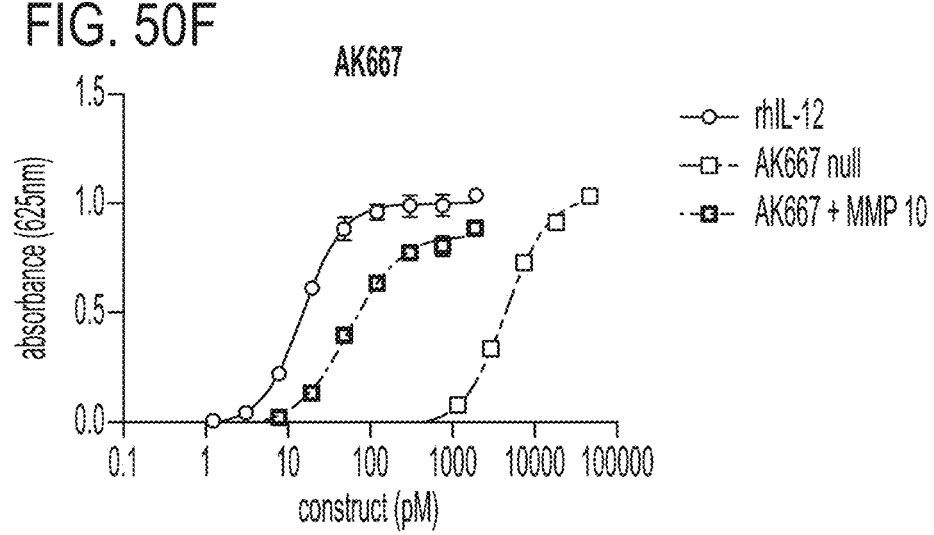
FIG. 50F shows EC50 value for AK667 construct in absence and presence of MMP 7 protease.
Figure 50G:
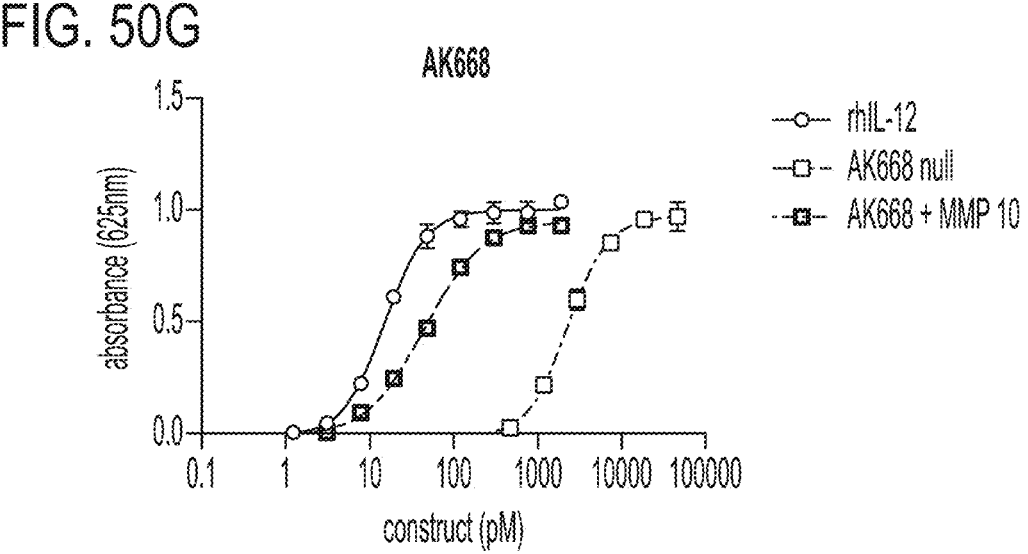
FIG. 50G shows EC50 value for AK668 construct in absence and presence of MMP 7 protease.
Figure 50H:
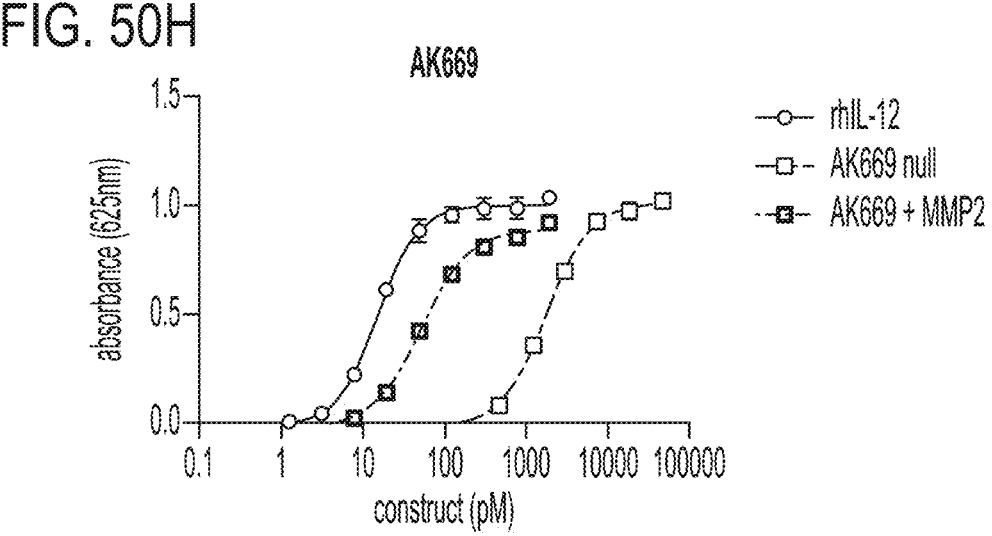
FIG. 50H shows EC50 value for AK669 construct in absence and presence of MMP 7 protease.
Figure 50I:
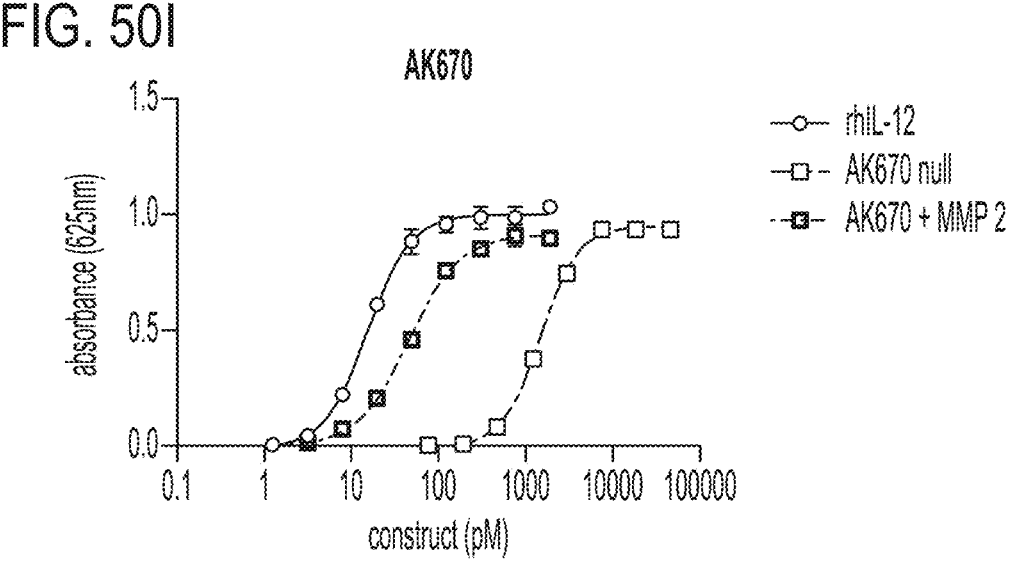
FIG. 50I shows EC50 value for AK670 construct in absence and presence of MMP 7 protease.
Figure 50J:
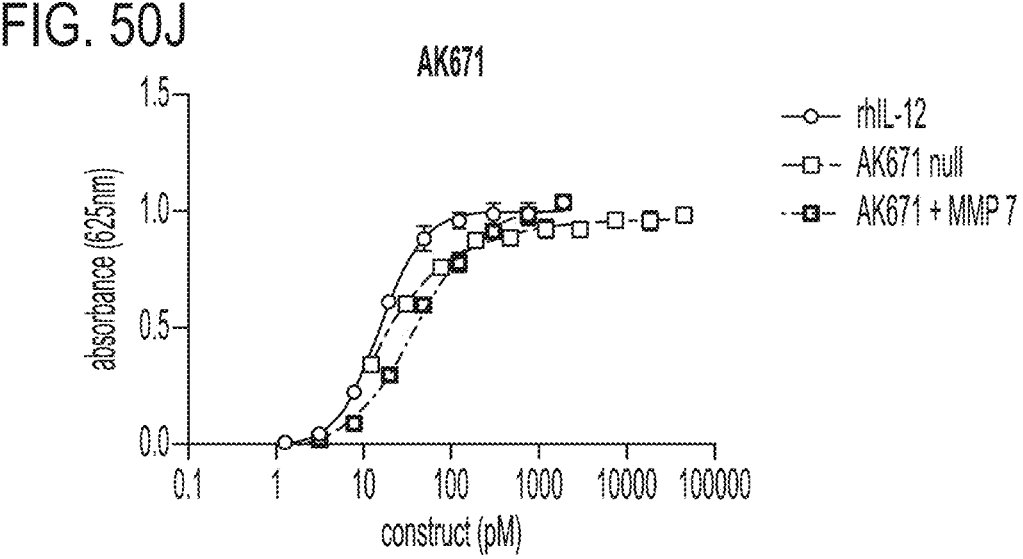
FIG. 50J shows EC50 value for AK671 construct in absence and presence of MMP 7 protease.
Figure 50K:
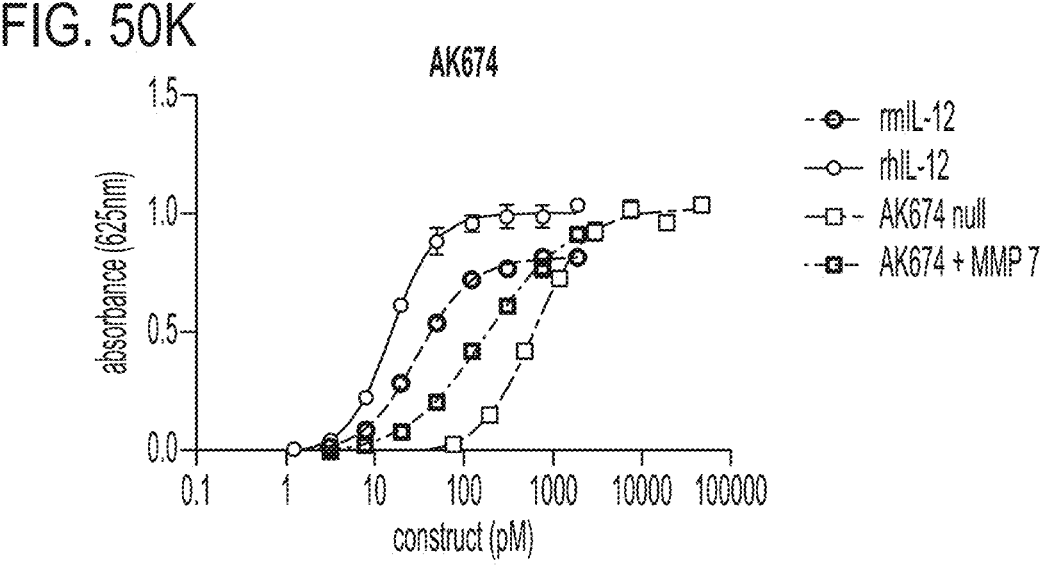
FIG. 50K shows EC50 value for AK674 construct in absence and presence of MMP 7 protease.
Figure 51A:
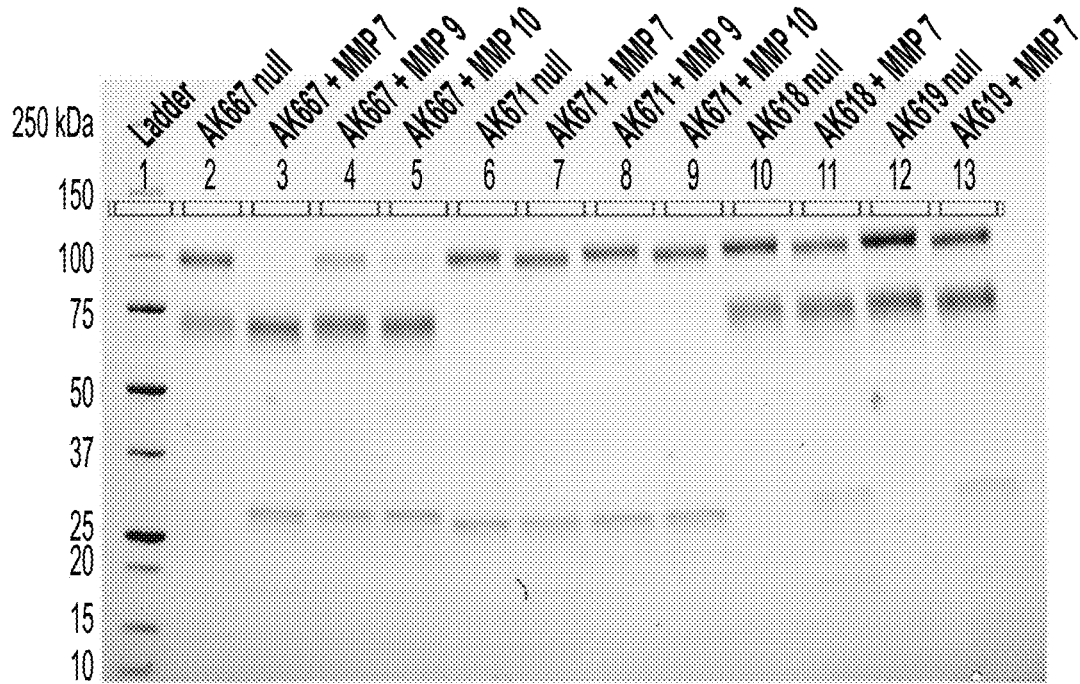
FIGS. 51A and 51B show the cleavage of different constructs by MMP 7, MMP 9, or MMP 10 protease.
Figure 51B:
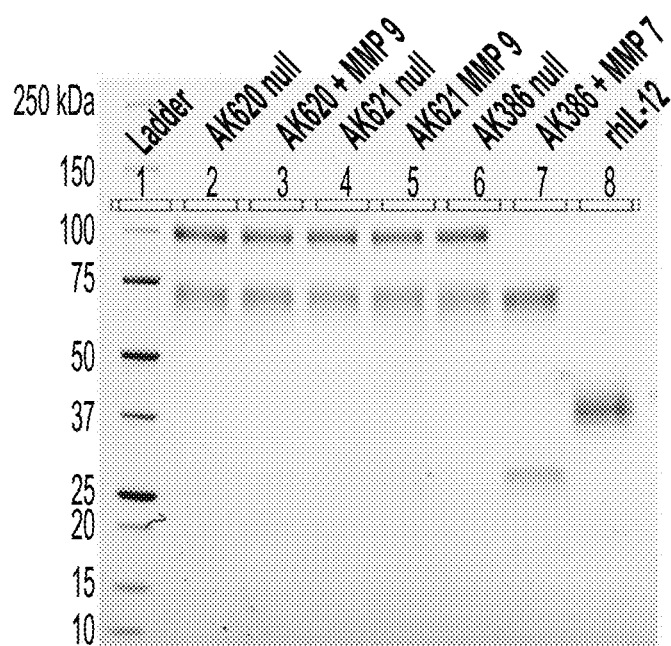
Figure 52A:
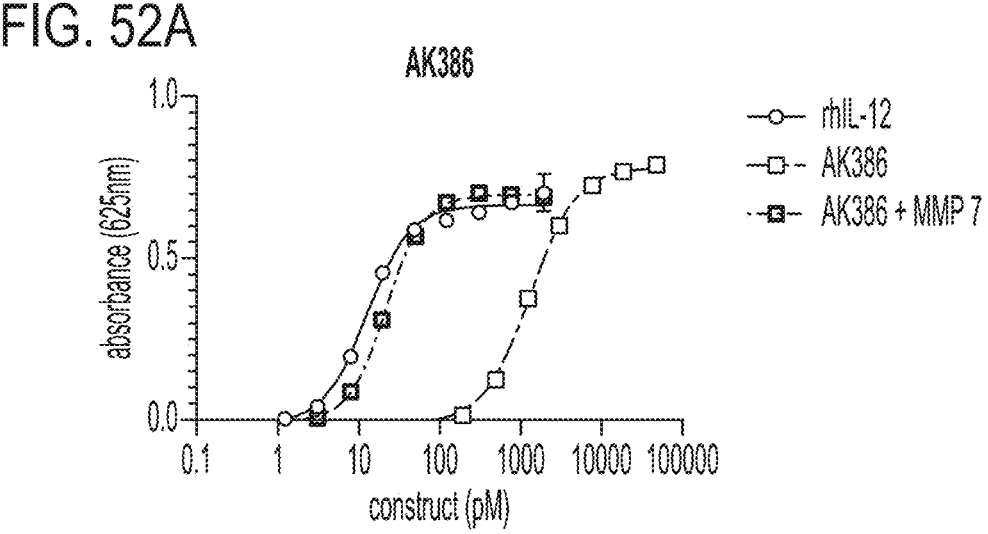
FIG. 52A shows EC50 value for AK386 construct in absence and presence of MMP 7 protease.
Figure 52B:
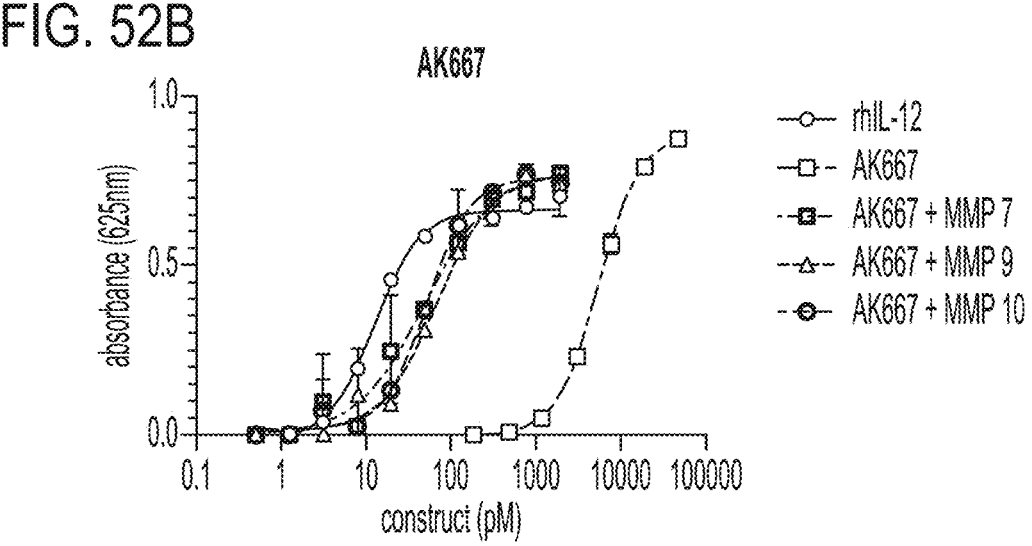
FIG. 52B shows EC50 value for AK667 construct in absence of any protease or in presence of MMP 7, MMP 9, or MMP 10 protease.
Figure 52G:
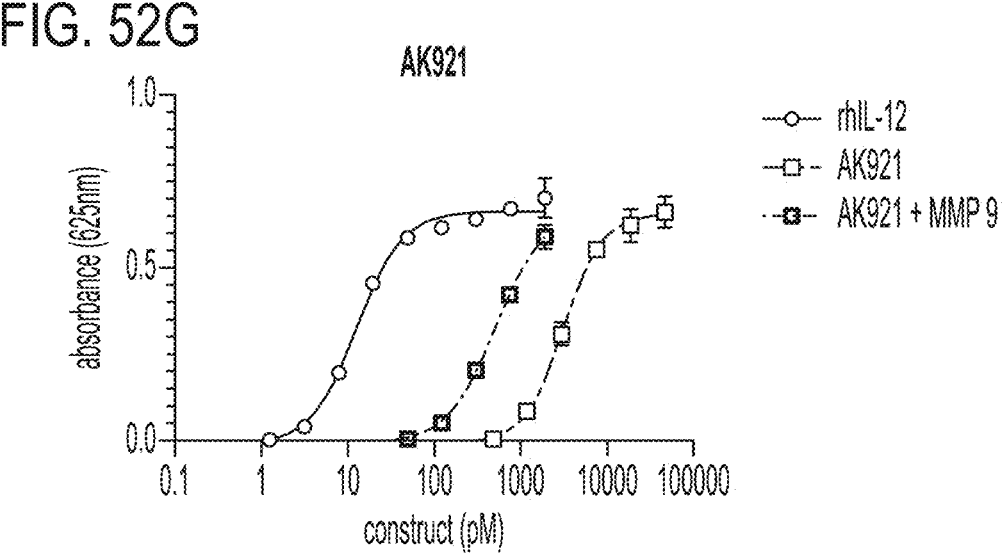
FIG. 52G shows EC50 value for AK921 construct in absence and presence of MMP 9 protease.
Figure 53:
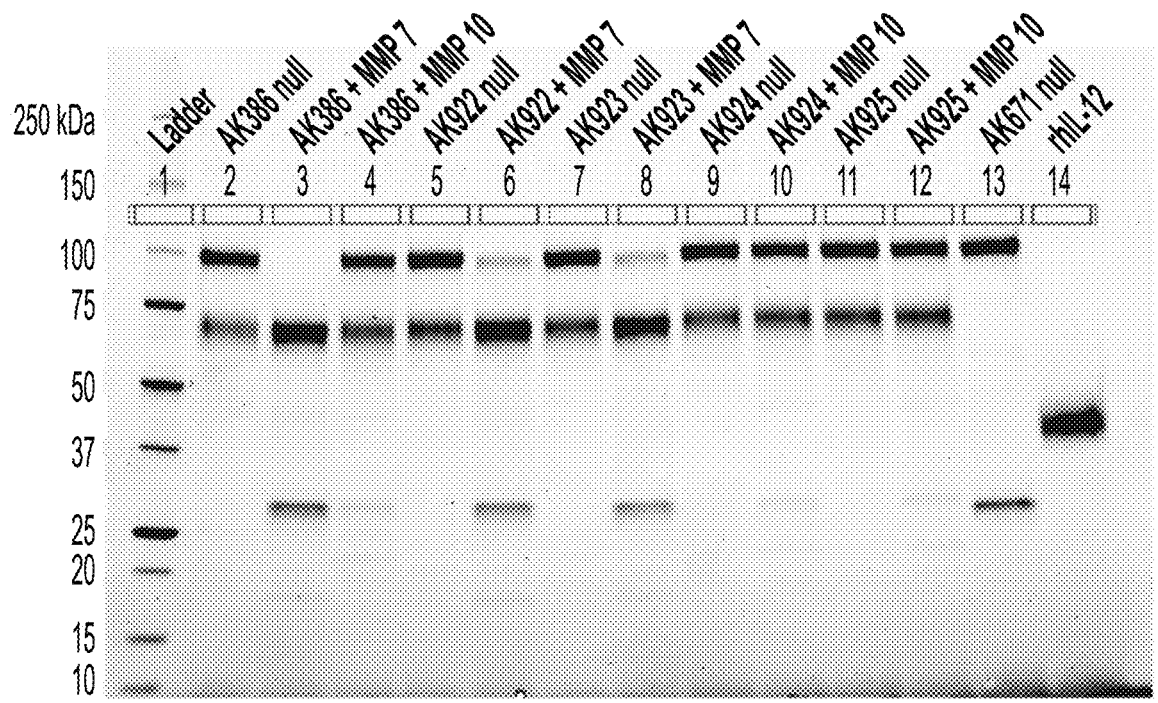
FIG. 53 shows the cleavage of different constructs by MMP 7 or MMP 10 protease.
Figure 54A:
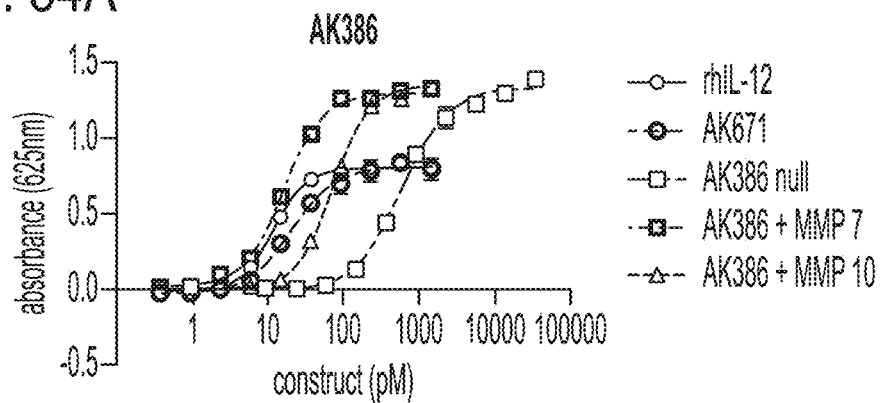
FIG. 54A shows EC50 value for AK386 construct in absence and presence of MMP 7 or MMP 10 protease.
Figure 54B:
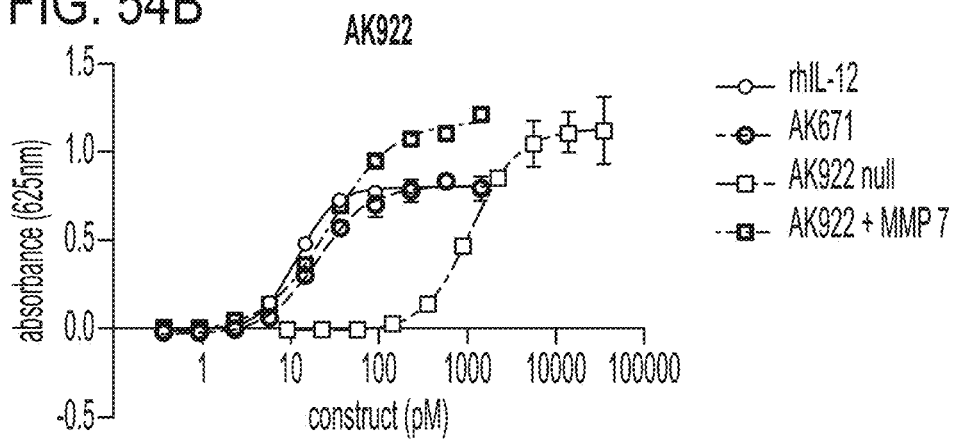
FIG. 54B shows EC50 value for AK922 construct in absence and presence of MMP 7 protease.
Figure 54C:
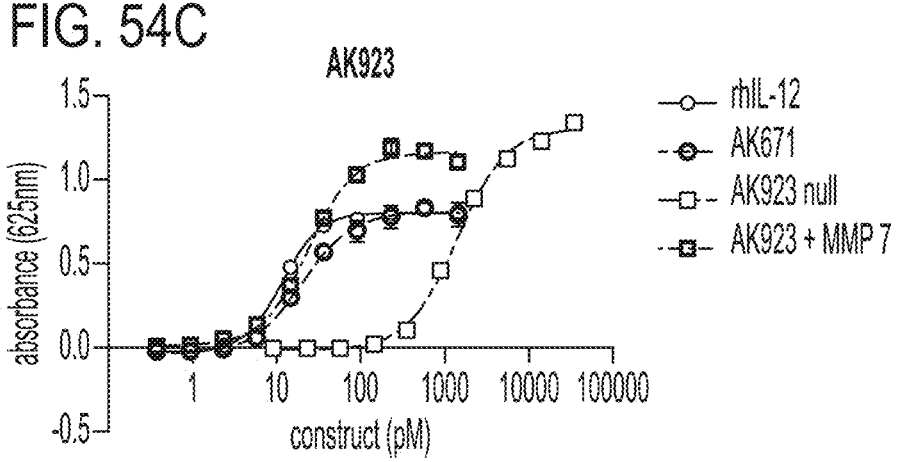
FIG. 54C shows EC50 value for AK923 construct in absence and presence of MMP 7 protease.
Figure 54D:
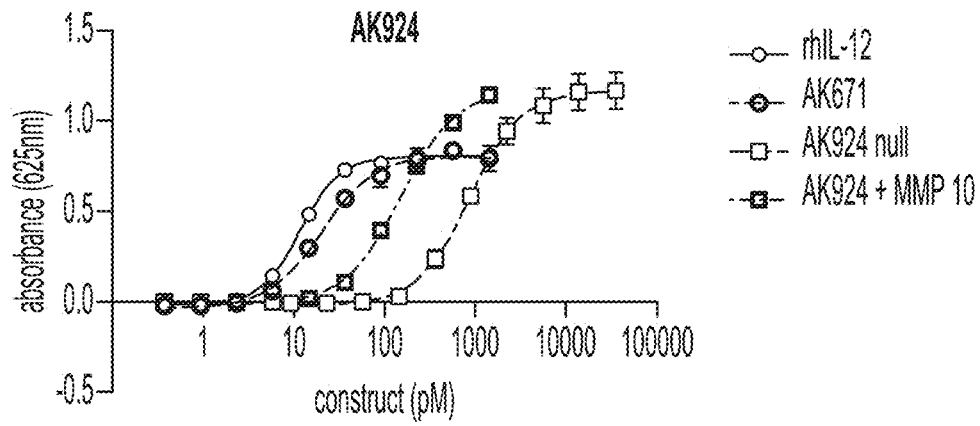
FIG. 54D shows EC50 value for AK924 construct in absence and presence of MMP 7 protease.
Figure 54E:
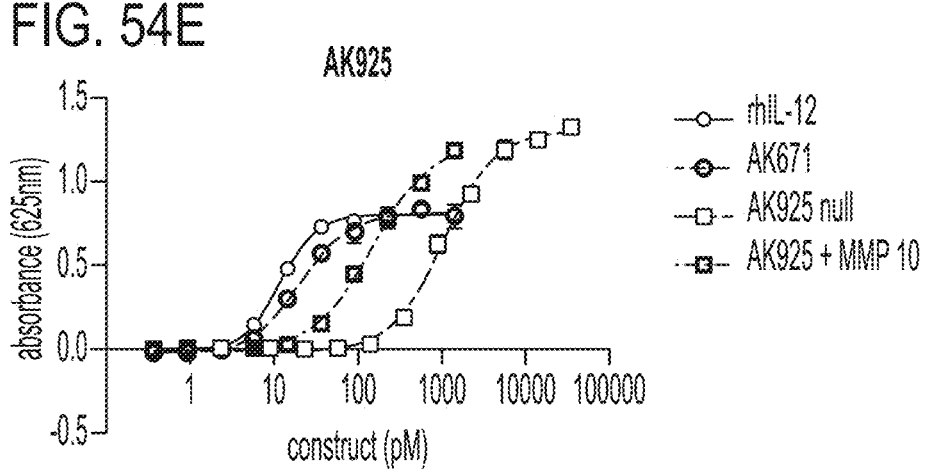
FIG. 54E shows EC50 value for AK925 construct in absence and presence of MMP 7 protease.
Figure 72:
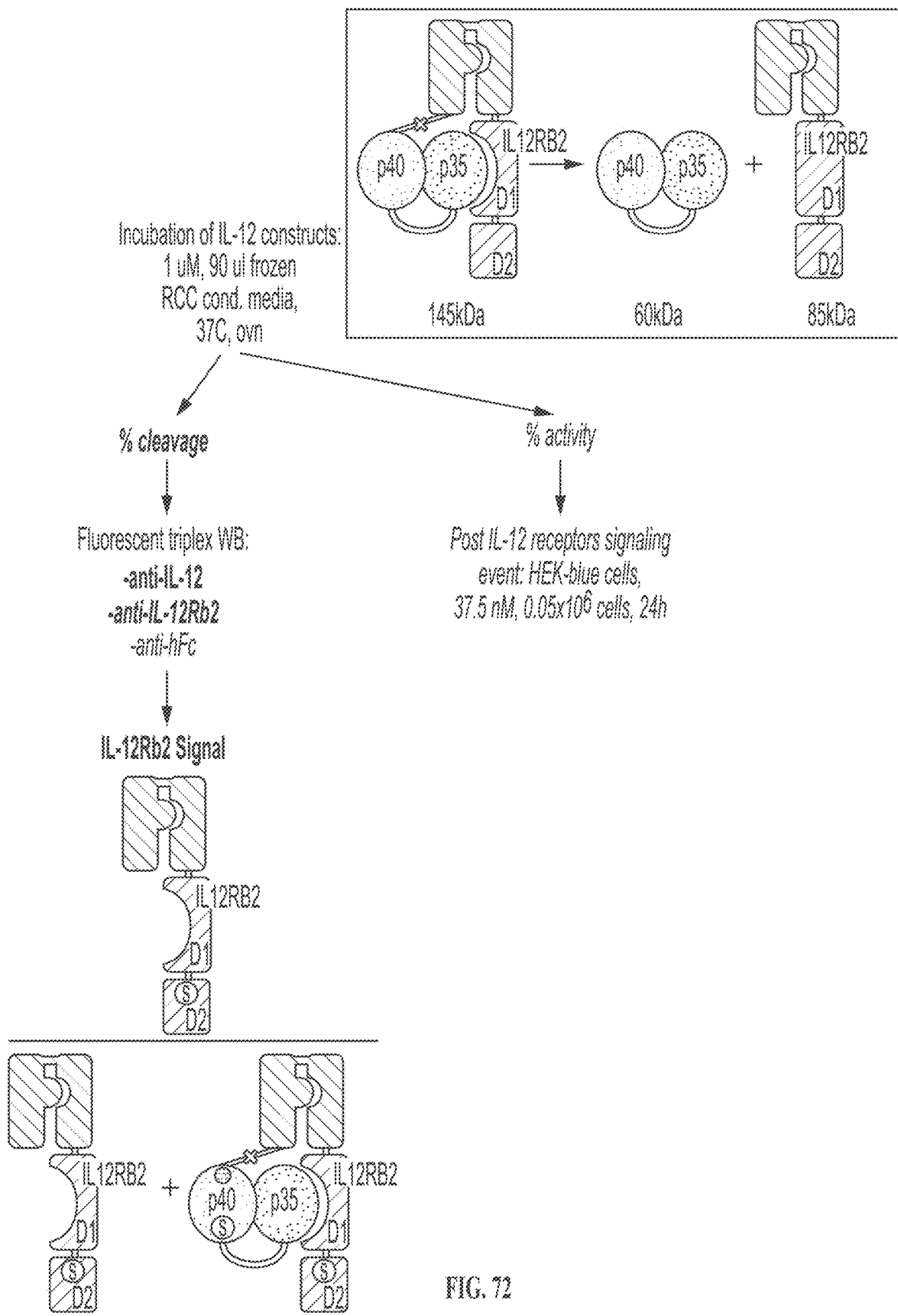
FIG. 72 shows the flowchart used in ex vivo cleavage assay.

The flowchart used in this Example is shown in FIG. 72. Results are shown in FIG. 46 and in the tables below.

Molecules with the following cleavage sites exhibited readily detectable cleavage in the tumor supernatants:

RAAAVKSP (SEQ ID NO: 27)

ISSGLLSGRS (SEQ ID NO: 249)

MPYDLYHP (SEQ ID NO: 24)

The cleavage sites sensitivity was observed in the following order:

RAAAVKSP (SEQ ID NO: 27)>ISSGLLSGRS (SEQ ID NO: 249)>MPYDLYHP (SEQ ID NO: 24) Therefore, the IL-12 constructs that harbor these cleavage sites represent good candidates for tumor selective activation in RCC and other types of cancers.

| Cutoff 1%, n = 30 | % Cleavage | | | | % Activity (signalinh assay) | | | |
|---|---|---|---|---|---|---|---|---|
| | ISSGLLSGRS | | | | ISSGLLSGRS | | | |
| | AK669 | AK670 | AK922 | AK923 | AK669 | AK670 | AK922 | AK923 |
| % of samples with >1% Cleavage, activity | 2 | 5 | 2 | 2 | 3 | 9 | 1 | 8 |
| Frequency of cleavage, activation (%) | 6.7 | 16.7 | 6.7 | 6.7 | 10.0 | 30.0 | 3.3 | 26.7 |
| % Activation (Median) | 5.5 | 1.8 | 5.8 | 8.2 | 1.7 | 2.2 | 5.8 | 1.2 |
| | RAAAVKSP | | | | RAAAVKSP | | | |
| | AK920 | AK921 | AK924 | AK925 | AK920 | AK921 | AK924 | AK925 |
| % of samples with >1% Cleavage, activity | 7 | 4 | 3 | 3 | 7 | 5 | 6 | 7 |
| Frequency of cleavage, activation (%) | 23.3 | 13.3 | 10.0 | 10.0 | 23.3 | 16.7 | 20.0 | 23.3 |
| % Activation (Median) | 1.8 | 2.0 | 13.6 | 2.6 | 1.9 | 2.5 | 1.8 | 1.7 |
| | MPYDLYHP | | | | MPYDLYHP | | | |
| | AK667 | AK668 | | | AK667 | AK668 | | |
| % of samples with >1% Cleavage, activity | 2 | 2 | | | 5 | 8 | | |
| Frequency of cleavage, activation (%) | 6.7 | 6.7 | | | 16.7 | 26.7 | | |
| % Activation (Median) | 2.3 | 2.7 | | | 1.5 | 1.7 | | |
| | VPLSLYSG | | | | VPLSLYSG | | | |
| | AK665 | AK666 | | | AK665 | AK666 | | |
| % of samples with >1% Cleavage, activity | 7 | 1 | | | 7 | 4 | | |
| Frequency of cleavage, activation (%) | 23 | 3 | | | 23 | 13 | | |
| % Activation (Median) | 2.5 | 1 | | | 2.1 | 1.6 | | |

-continued

| Cutoff 1%, n = 30 | % Cleavage | | % Activity (signalinh assay) | |
|---|---|---|---|---|
| | DSGGFMLT | | DSGGFMLT | |
| | AK918 | AK919 | AK918 | AK919 |
| % of samples with >1% Cleavage, activity | 5 | 4 | 3 | 5 |
| Frequency of cleavage, activation (%) | 17 | 13 | 10 | 17 |
| % Activation (Median) | 1.8 | 2.1 | 1.7 | 1.3 | ii) In Vitro Cleavage Analysis: HEK Blue IL-12 and SDS-PAGE Analysis
Testing JL-12 Molecules with HEK-Blue JL-12 Cells:

HEK-Blue JL-12 reporter cells developed by Invivogen have been specifically designed to monitor the activation of the JAK-STAT pathway. These cells were generated by stable transfection of HEK293 cells with the human IL-12Rβ1 and IL-12Rβ2 genes, along with the human TyK2, JAK2, and STAT4 genes to obtain a fully functional JL-12 signaling pathway. In addition, a STAT4-inducible SEAP reporter gene was also introduced. Upon stimulation, HEK-Blue™ JL-12 cells trigger the activation of STAT4 and the subsequent secretion of SEAP. The levels of STAT4-induced SEAP can be readily monitored using QUANTI-Blue™. HEK-Blue JL-12 cells can be used to validate the functionality, toxicity, and variable dosage effects of human or murine JL-12. HEK Blue JL-12 cells were grown in passage media until ~80% confluent. Washed single-cell suspension in assay media was plated and serial dilutions of JIL-12 molecules in assay media were added to cells. Plate was incubated at 37° C. for 24 h. After 24 h, Quanti-Blue solution (Invivogen) was prepared and cell supernatant was added to the Quanti-Blue solution and incubated for 1-2 h at 37° C. Absorbance at 625 nm measured. Data analysis was performed in Graphpad Prism, version 8.3. Background was subtracted from raw data and the data were fit nonlinearly: [Agonist]vs. response-Variable slope (four parameters). EC50 value of each IL-12 construct was reported.
Masking:
Results are shown in the tables below and in FIGS. 47, 48A and B.

| Construct | Run 1, $EC_{50}$ | Aklusion | Run 2, $EC_{50}$ | Aklusion | Average Aklusion |
|---|---|---|---|---|---|
| AK671 | 24.7 | N/A | 15.2 | N/A | N/A |
| rhIL-12 | 9.6 | N/A | 8.2 | N/A | N/A |
| AK386 null | 477.9 | 19.4 | 367.5 | 14.9 | 17.1 |
| AK664 null | 1854.0 | 75.2 | 1677.0 | 68.0 | 71.6 |
| AK665 null | 1303.0 | 52.9 | 1491.0 | 60.5 | 56.7 |
| AK666-01A null | 1775.0 | 72.0 | 2009.0 | 81.5 | 76.8 |
| AK666-02A null | 1725.0 | 70.0 | 1537.0 | 62.4 | 66.2 |
| AK667 null | 3104.0 | 125.9 | 2035.0 | 82.6 | 104.2 |
| AK668 null | 1383.0 | 56.1 | 1370.0 | 55.6 | 55.8 |
| AK669 null | 895.6 | 36.3 | 1193.0 | 48.4 | 42.4 |
| AK670 null | 740.9 | 30.1 | 862.1 | 35.0 | 32.5 |
| AK922 null | 1183.0 | 48.0 | 1101.0 | 44.7 | 46.3 |
| AK923 null | 1562.0 | 63.4 | 1188.0 | 48.2 | 55.8 |
| AK918 null | 2886.0 | 117.1 | 3116.0 | 126.4 | 121.7 |
| AK919 null | 1230.0 | 49.9 | 1475.0 | 59.8 | 54.9 |
| AK920 null | 1116.0 | 45.3 | 1116.0 | 45.3 | 45.3 |
| AK921 null | 1638.0 | 68.9 | 1352.0 | 54.8 | 61.9 |
| AK924 null | 1030.0 | 41.8 | 766.4 | 31.1 | 36.4 |
| AK925 null | 995.1 | 40.4 | 914.8 | 37.1 | 38.7 |

Parental AK671 is less potent than rhIL-12 (but not significantly, i.e. 3-fold). All masked constructs are more aklduded than AK386. AK667 and AK918 are both >100-fold aklduded.

As compared to AK386, the new molecules that have the GAG-binding domain mutation, the cysteines to serines mutations, new optimized linkers, as well as different cleavage sites, all exhibit improved masking.
Cleavage:

Cleavage of the constructs was testing using exemplary proteases MMP7, 9 and 10.
Batch 1

| AK ID | Protein Lot # | 300 ng MMP | Total construct cleaved, ug |
|---|---|---|---|
| AK663 | AK663-01A | 7 | 8.8 |
| AK664 | AK664-01A | 7 | 14.8 |
| AK665 | AK665-01A | 7 | 14.8 |
| AK666 | AK666-01A | 7 | 14.8 |
| AK667 | AK667-01A | 10 | 14.9 |
| AK668 | AK668-01A | 10 | 14.9 |
| AK669 | AK669-01A | 2 | 14.9 |
| AK670 | AK670-01A | 2 | 14.9 |
| AK671 | AK671-01A | 7 | 11.3 |
| AK386 | AK386-03A | 7 | 14.9 |
| AK674 | AK674-01A | 7 | 15.1 |

Results are shown in FIGS. 49A-B and 50A-K
Batch 2

| AK ID | Protein Lot # | 300 ng MMP | Total construct cleaved, ug |
|---|---|---|---|
| AK667 | AK667-01A | 7, 9, 10 | 14.86 |
| AK671 | AK671-01A | 7, 9, 10 | 11.31 |
| AK918 | AK918-01A | 7 | 14.84 |
| AK919 | AK919-01A | 7 | 14.85 |
| AK920 | AK920-01A | 8 | 14.83 |
| AK921 | AK921-01A | 9 | 14.84 |
| AK386 | AK386-03A | 7 | 14.90 |

Results are shown in FIGS. 51A-B and 52A-G
Batch 3

| AK ID | Protein Lot # | 300 ng MMP | Total construct cleaved, ug |
|---|---|---|---|
| AK386 | AK386-04A | 7, 10 | 14.9 |
| AK922 | AK922-01A | 7 | 14.9 |
| AK923 | AK923-01A | 7 | 14.9 |
| AK924 | AK924-01A | 10 | 14.8 |
| AK925 | AK925-01A | 10 | 14.9 |
| AK671 | AK671-02A | N/A | N/A |

Results are shown in FIGS. 53 and 54A-E

Overall, the new molecules with different cleavage sites are all susceptible to MMP cleavage in vitro. For all the molecules, there is a restoration of activity post cleavage. These compounds represent good candidates for tumor selective activable IL-12 molecules.

Example 10

Figure 73A:
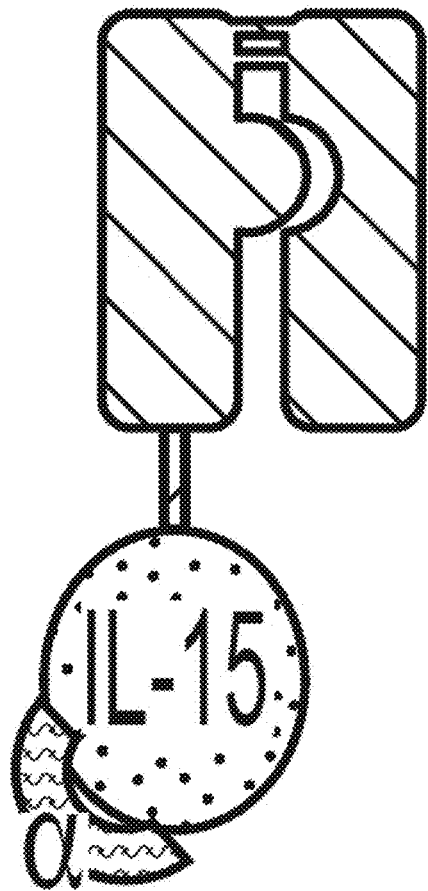
FIG. 73A shows schematic diagram of positive control unmasked AK904 and FIG. 73B shows schematic diagram of cleavage control: masked, non-cleavable AK910 as used in Example 10.
Figure 73B:
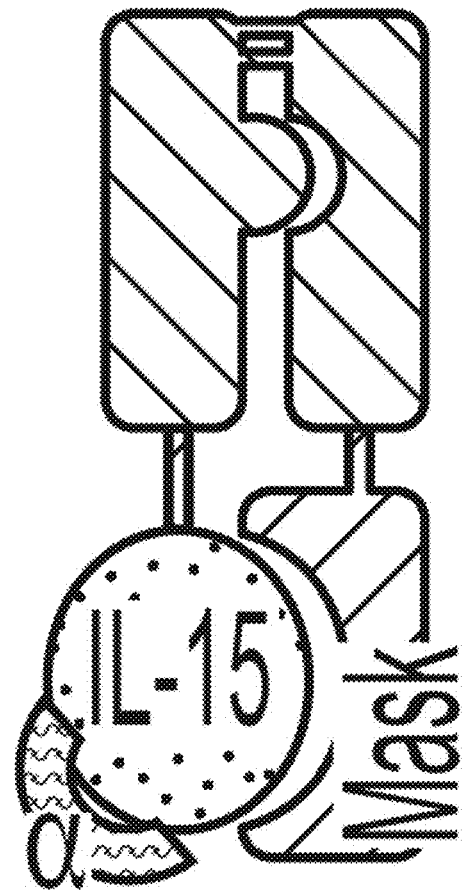
Figure 74:
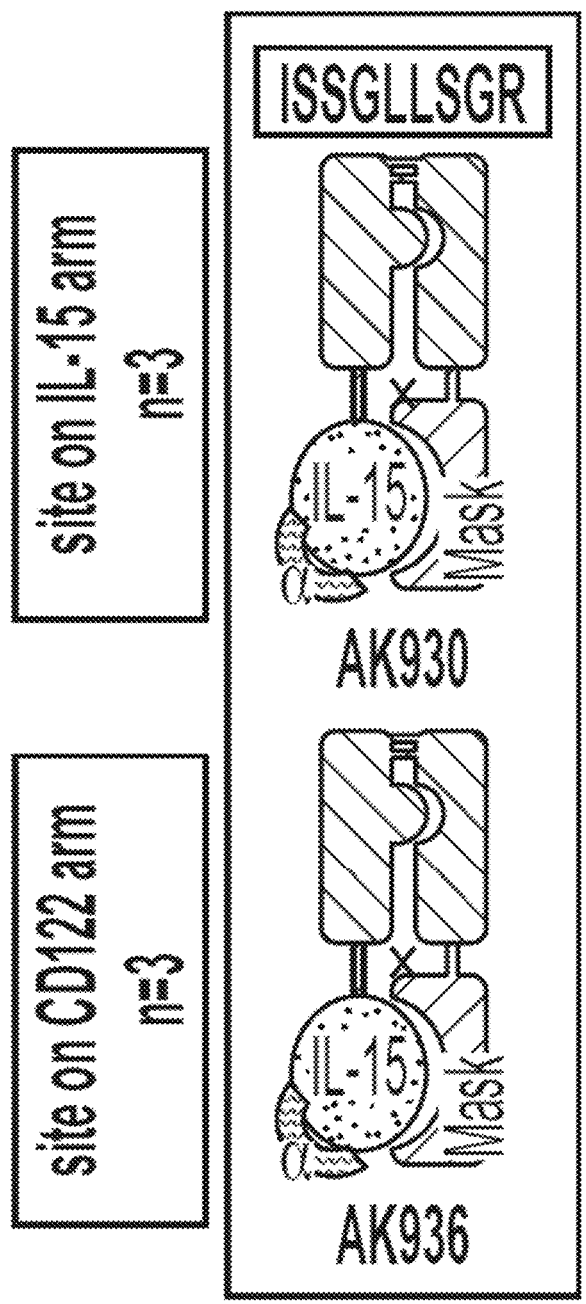
FIG. 74 shows schematic diagram of masked cleavable molecules used in Example 10, cytokine-substrate construct: AK930 and mask-substrate construct: AK936.

The following constructs were used in this example:
Control molecules (as shown in FIG. 73A and FIG. 73B)
Positive control: unmasked AK904 (FIG. 73A)
Cleavage control: masked, non-cleavable AK910 (FIG. 73B)
Masked cleavable molecules: (as shown in FIG. 74)
Cytokine-substrate construct: AK930
Mask-substate construct: AK936

Details on the domain features and sequences of each AK molecule is set out in Example 8.

CT26 Murine Tumor Model—In Vivo Evaluation of the PD of Test Articles in the Treatment of CT26 Tumor Bearing Mice Balb/c mice were injected with CT26 cells s.c. and monitored for tumor growth. Once tumor sizes reached 175-225 mm3, animals were randomized (n=4 per group). A single i.v. injection of test article was administered at dose levels according to the table. Body weights were measured on day 0 and day 5. On day 5, animals were sacrificed, and tissues were collected for immunophenotyping.

|   | Test Molecule | Dosing (nMoles/kg) | Dosing (mg/kg) |
|---|---|---|---|
| 1 | Vehicle | * | * |
| 2 | AK904 (parental) | 6.7 | 0.43 |
| 3 | AK904 (parental) | 22.2 | 1.45 |
| 4 | AK910 (NC) | 222 | 20 |
| 5 | AK930 | 66.6 | 6 |
| 6 | AK930 | 222 | 20 |
| 7 | AK936 | 66.6 | 6 |
| 8 | AK936 | 22.2 | 2 |

* Vehicle volume is the same volume of the highest-dosed group.

The Results are as follows.

i) Tissue Weight, Tumor Weight and Body Weight Change (%) on Day 5

Figure 55A:
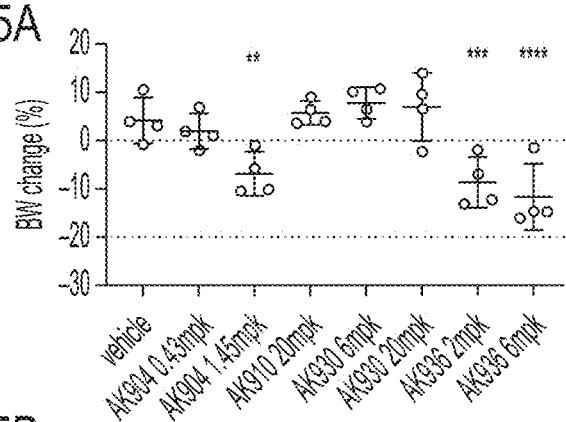
FIGS. 55A-D show results from pharmacokinetic studies carried out in CT26 tumor-bearing mice using the construct AK904, AK910, AK930 or AK936.

FIG. 55A: Mice treated with high dose AK904 and AK931 and low and high doses of AK936 demonstrated a significant loss in body weight.

Figure 55B:
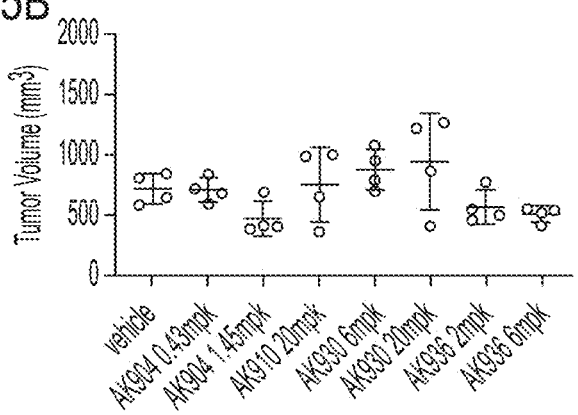

FIG. 55B: No significant difference in tumor volume was observed across all treated mice.

Figure 55C:
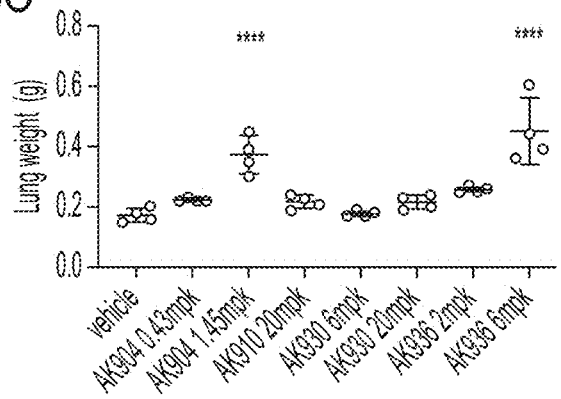

FIG. 55C: Mice treated with high dose AK904 and AK936 demonstrated a significant increase in lung weight.

Figure 55D:
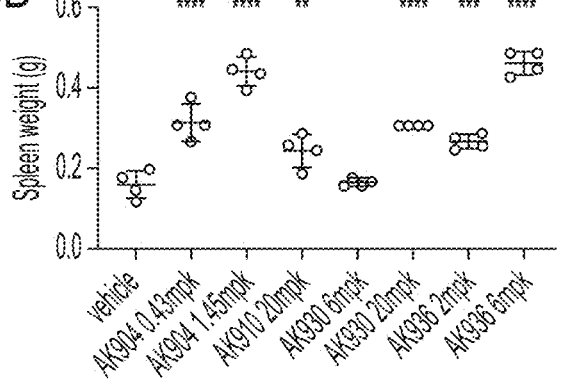

FIG. 55D: A significant increase in spleen weight was demonstrated in all mice treated with test article, either with low dose, high dose, or both dosing regimens.

ii) NK Cell Frequency

Figure 56A:
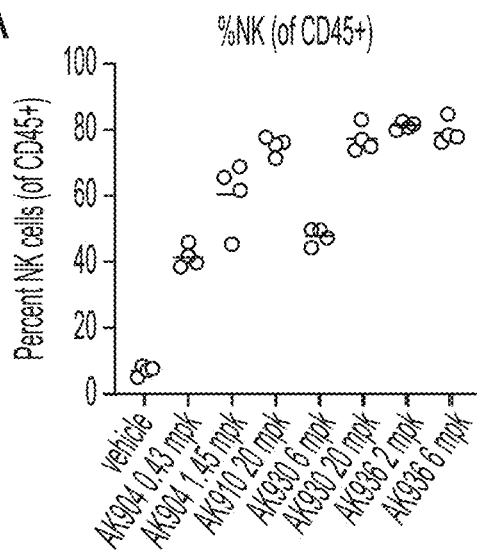
FIGS. 56A-C show results from studies testing the in vivo responses of NK cells as percentages of CD45+ cells in blood, spleen, and tumor.
Figure 56B:
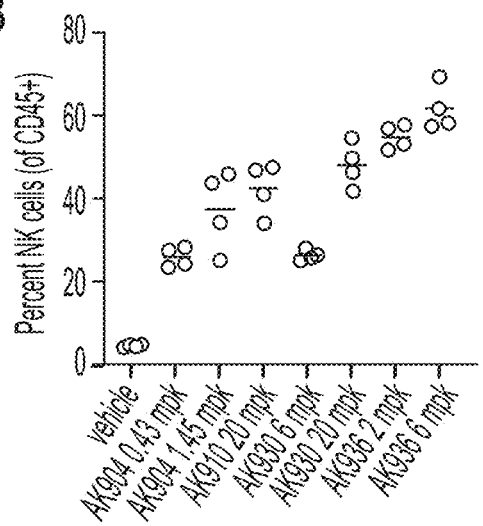

FIGS. 56A and B: Mice demonstrated a dose-dependent increase in % NK cells in the blood and spleen.

Figure 56C:
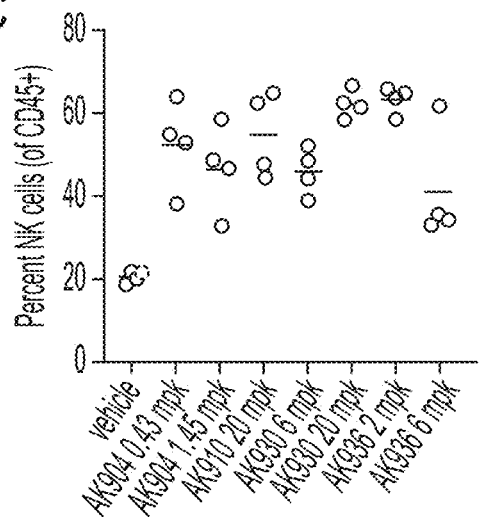

FIG. 56C: Mice in all treatment groups demonstrated increase % NK in the tumor.

iii) NK Ki67 MFI

Figure 57A:
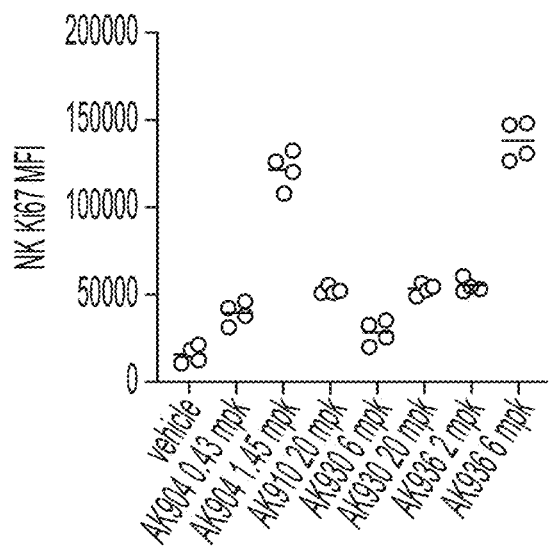
FIGS. 57A-C show results from studies testing the in vivo responses of NK cell proliferation as MFI of Ki67 in blood, spleen, and tumor.
Figure 57B:
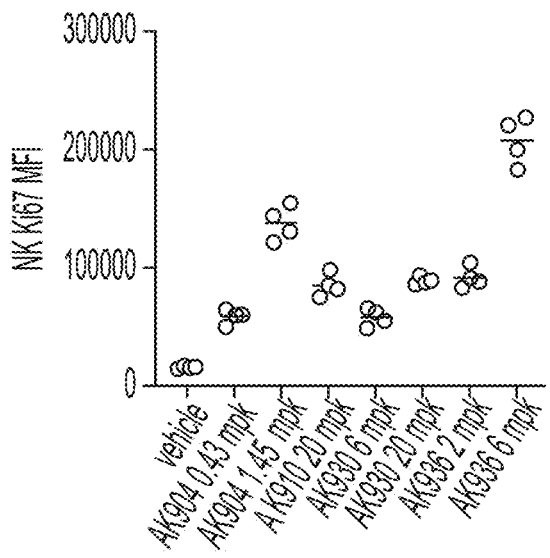
Figure 57C:
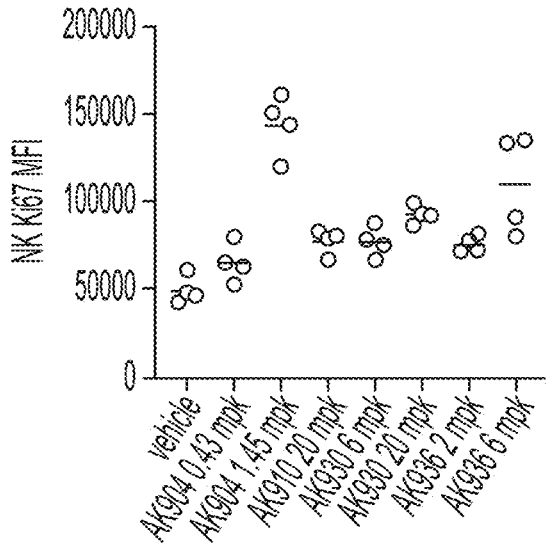

FIGS. 57A, B, and C: Mice demonstrated a dose-dependent increase in proliferation marker Ki67 in NK cells in the blood, spleen, and tumor.

iv) CD8+ T Cell Frequency

Figure 58A:
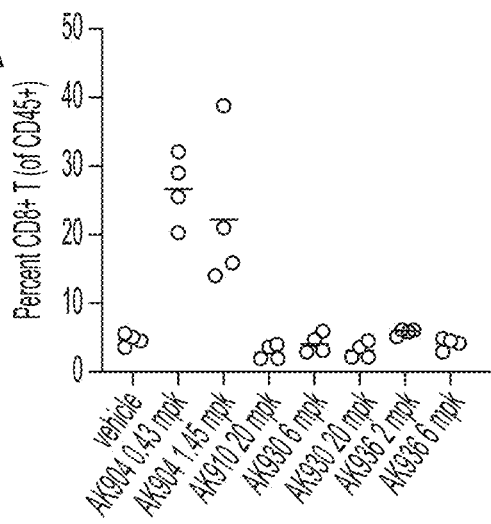
FIGS. 58A-C show results from studies testing the in vivo responses of CD8 T cells as percentages of CD45+ cells in blood, spleen, and tumor.

FIG. 58A: Mice treated with unmasked AK904 demonstrated a dose-dependent increase in % CD8 T cells in the blood.

Figure 58B:
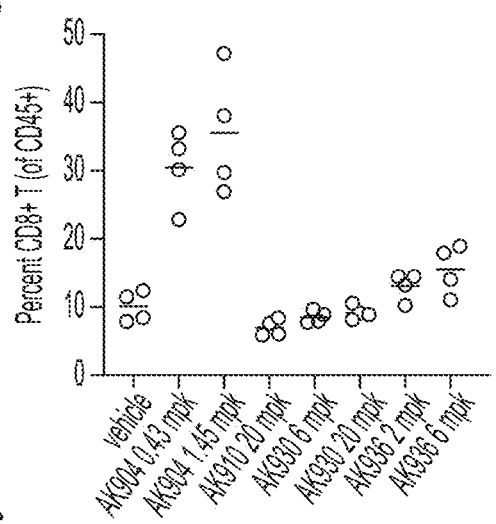

FIG. 58B: Mice demonstrated a dose-dependent increase in % CD8 T cells in the spleen.

Figure 58C:
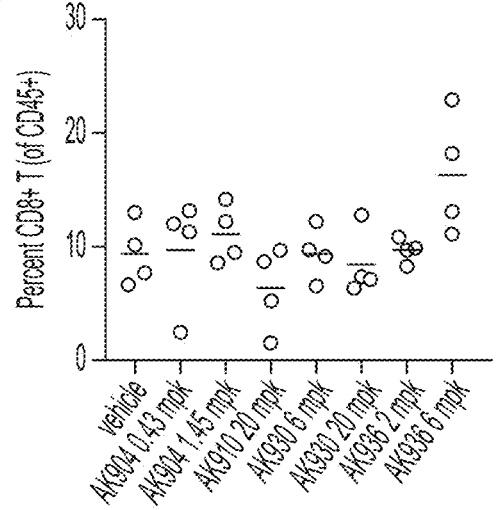

FIG. 58C: Mice in all treatment groups did not demonstrate an increase % CD8 T cells in the tumor (inconclusive evidence).

v) CD8+ T Ki67 MFI

Figure 59A:
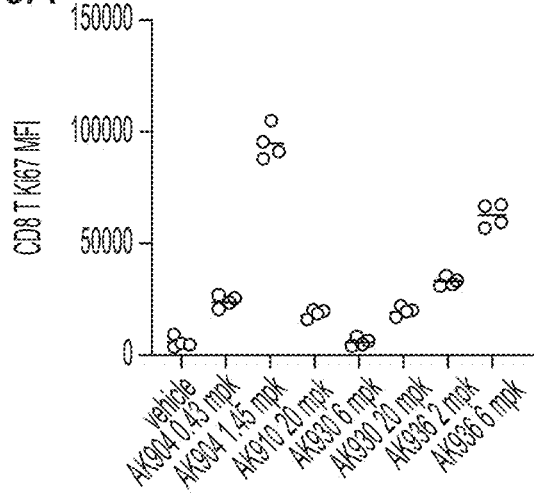
FIGS. 59A-C show results from studies testing the in vivo responses of CD8 T cell proliferation as MFI of Ki67 in blood, spleen, and tumor.
Figure 59B:
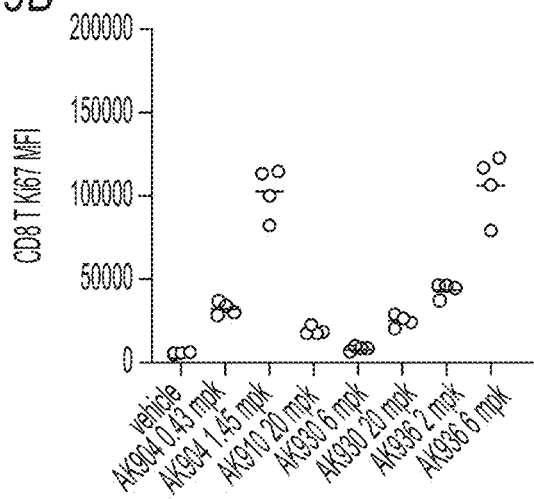

FIGS. 59A and B: Mice demonstrated a dose-dependent increase in proliferation marker Ki67 in CD8 T cells in the blood and spleen.

Figure 59C:
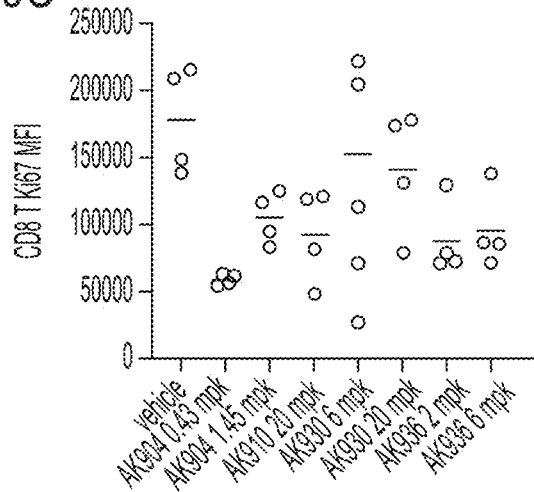

FIG. 59C: Mice in all treatment groups did not demonstrate an increase in Ki67 in CD8 T cells in the tumor.

vi) CD8+ T:Treg Ratio

Figure 60A:
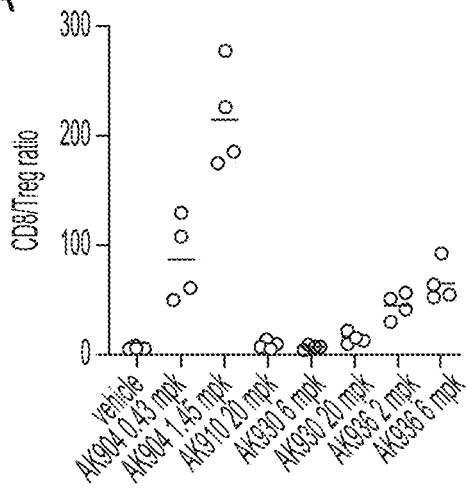
FIGS. 60A-C show results from studies testing the in vivo responses of CD8/Treg ratio in blood, spleen, and tumor.
Figure 60B:
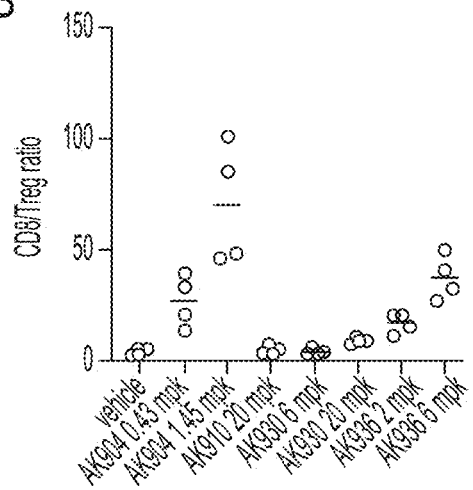

FIGS. 60A and B: Mice treated with AK904 and AK936 demonstrated a dose-dependent increased CD8/Treg ratio in the blood and spleen.

Figure 60C:
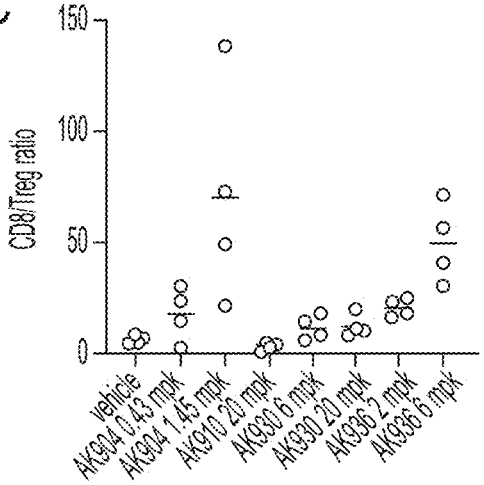

FIG. 60C: Mice treated with AK904, AK930 and AK936 demonstrated a dose-dependent increased CD8/Treg ratio in the tumor.

B16F10 Murine Tumor Model—IL-15 PKPD Study in B16-F10 Model

C57BL/6J mice were injected with MC38 cells s.c. and monitored for tumor growth. Once tumor sizes reached 175-225 mm3, animals were randomized (n=4 per group, except for AK904 and vehicle groups, which contained n=8 per group). A single i.v. injection of test article was administered at dose levels according to the table. Plasma was collected at 5 min, 2 h, 6 h, and on day 5 for PK analysis. Body weights were measured on day 0 and day 5. On day 5, animals were sacrificed, and tissues were collected for immunophenotyping.

|   | Test Molecule | Dosing (nMoles/kg) | Dosing (mg/kg) |
|---|---|---|---|
| 1 | Vehicle | * | * |
| 2 | AK904 (parental) | 6.7 | 0.43 |
| 3 | AK904 (parental) | 22.2 | 1.45 |
| 4 | AK910 (NC) | 66.6 | 6 |
| 5 | AK910 (NC) | 222 | 20 |
| 6 | AK930 | 66.6 | 6 |
| 7 | AK930 | 222 | 20 |
| 8 | AK936 | 66.6 | 6 |
| 9 | AK936 | 222 | 20 |

* Vehicle volume is the same volume of the highest-dosed group.

The Results are as follows.

i) Tissue Weight, Tumor Weight and Body Weight Change (%) on Day 5

Figure 61A:
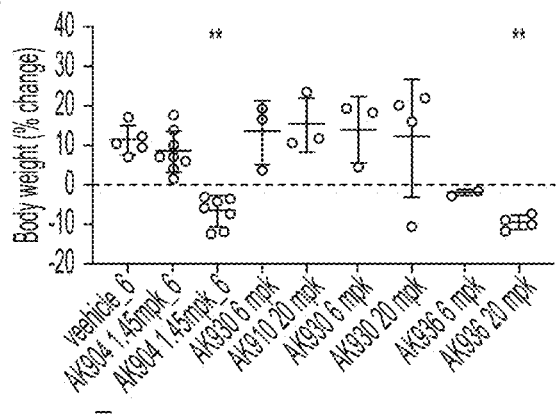
FIGS. 61A-D show results from pharmacokinetic studies carried out in B16F10 tumor-bearing mice using the construct AK904, AK910, AK930 and AK936.

FIG. 61A: Mice treated with high dose AK904 and AK936 demonstrated a significant loss in body weight.

Figure 61B:
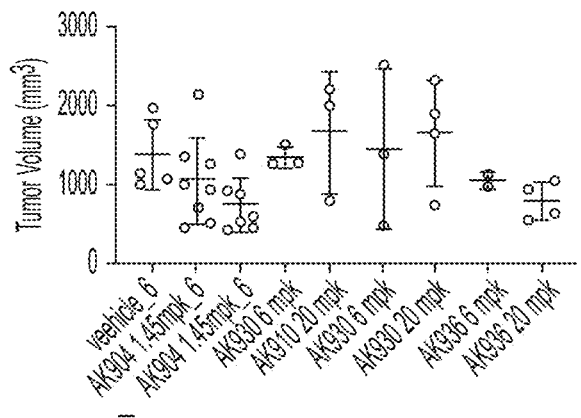

FIG. 61B: No significant difference in tumor volume was observed across all treated mice.

Figure 61C:
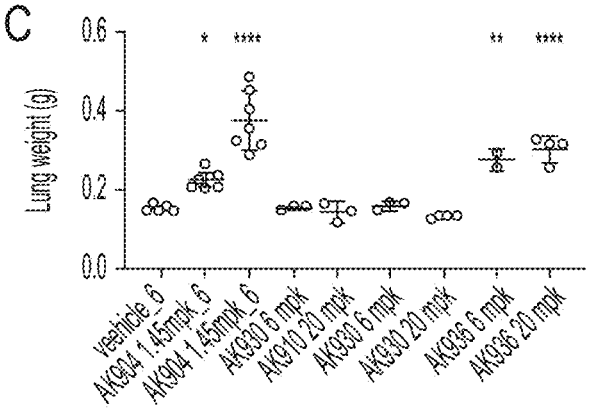

FIG. 61C: Mice treated with low and high dose AK904 and AK936 demonstrated a significant increase in lung weight.

Figure 61D:
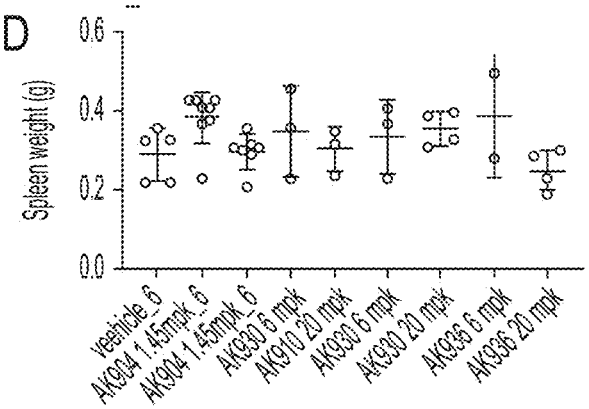

FIG. 61D: No significant increase in spleen weight was demonstrated in any mice treated with test article.

ii) Masked IL-15 Showed Longer Half-Life than Unmasked Control

Figure 62A:
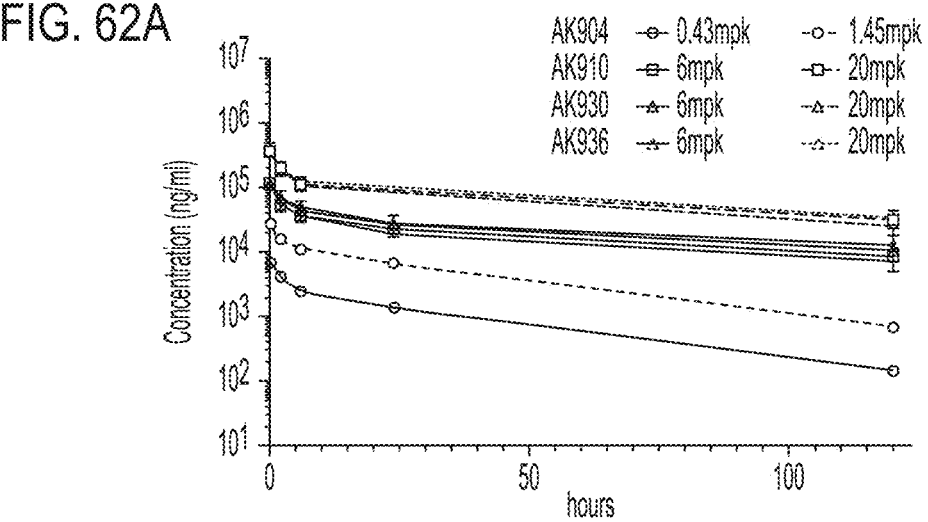
FIGS. 62A-D show results from pharmacokinetic studies carried out, as described Example 10, in B16F10 tumor-bearing mice using the construct AK904, AK910, AK930 and AK936.

FIG. 62A: A similar PK profile is observed between molecules AK910, AK930 and AK936.

Figure 62B:
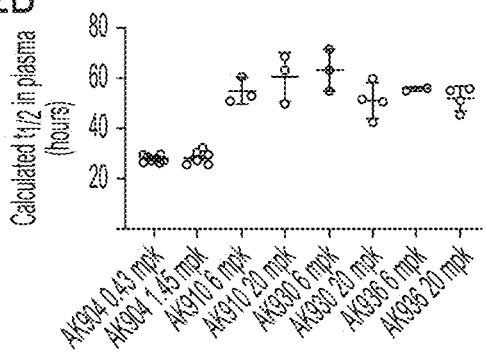

FIG. 62B: AK910, AK930 and AK936 have 2-3 fold longer half-life, compared to AK904.

Figure 62C:
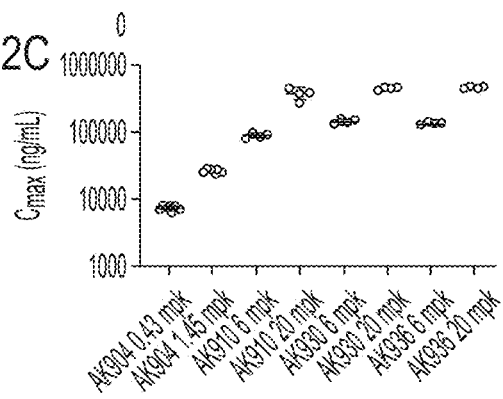
Figure 62D:
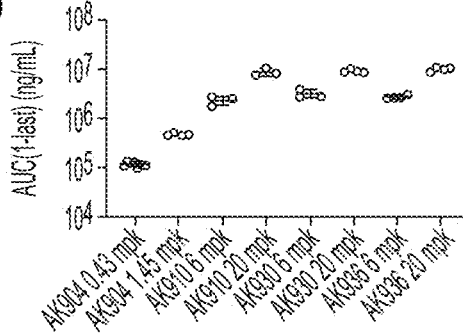

FIGS. 62C and D: AK910, AK930 and AK936 have similar and dose-dependent $C_{max}$ and $AUC_{(0-last)}$, as expected.

iii) NK

Figure 63A:
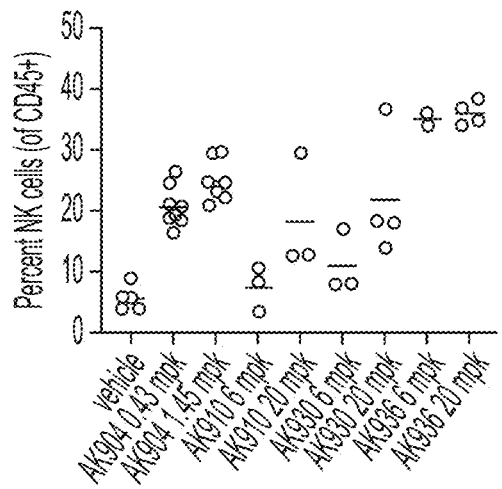
FIGS. 63A-C show results from studies testing the in vivo responses of NK cells as percentages of CD45+ cells in blood, spleen, and tumor.
Figure 63B:
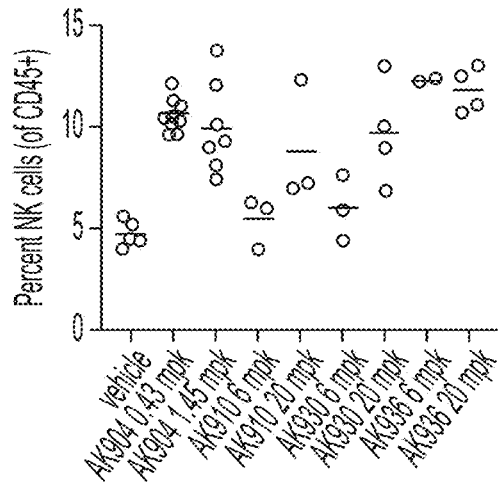
Figure 63C:
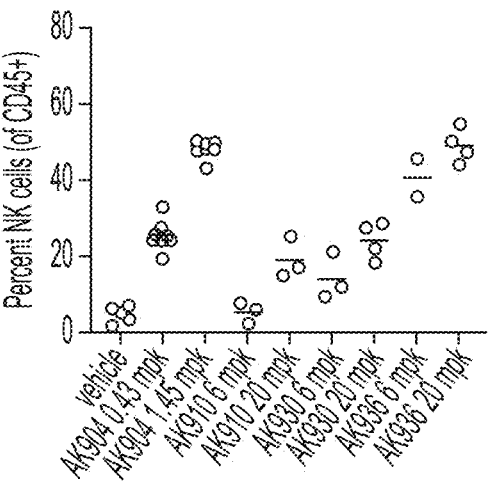

FIGS. 63A-C: Mice demonstrated a dose-dependent increase in % NK cells in the blood, spleen, and tumor.

iv) CD8+ T Cell

Figure 64A:
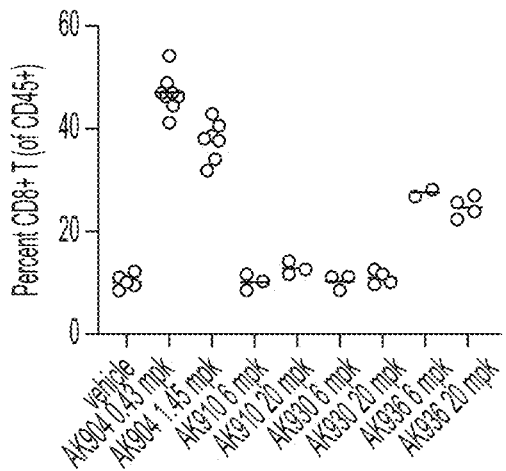
FIGS. 64A-C show results from studies testing the in vivo responses of CD8 T cells as percentages of CD45+ cells in blood, spleen, and tumor.
Figure 64B:
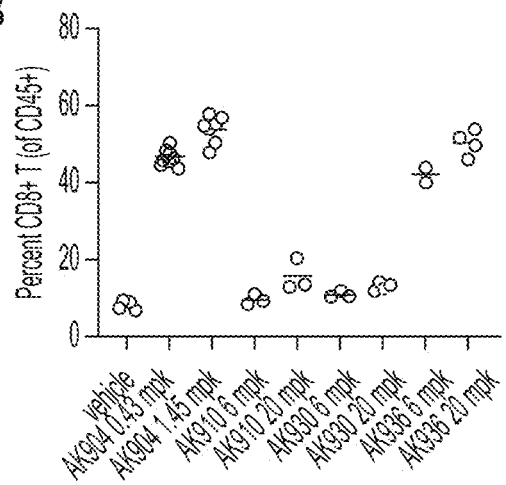

FIGS. 64A and B: Mice treated with AK904 and AK936 demonstrated an increase in % CD8 T cells in the blood and spleen.

Figure 64C:
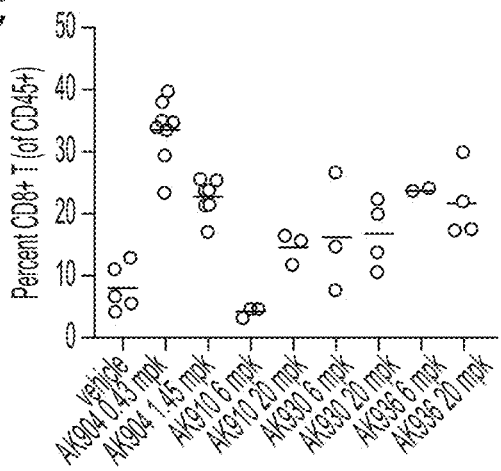

FIG. 64C: Mice in all treatment groups demonstrated an increase % CD8 T cells in the tumor.

v) CD8+ T:Treg Ratio

Figure 65A:
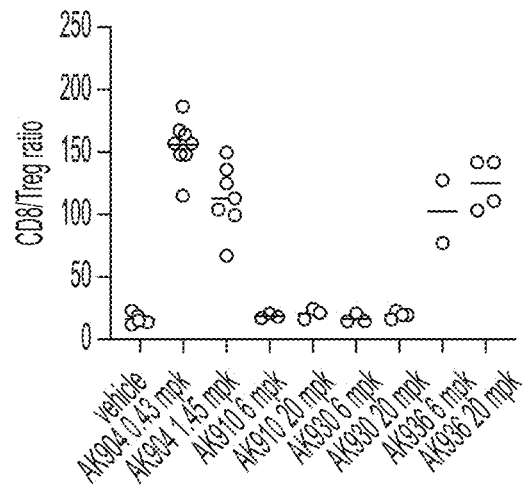
FIGS. 65A-C show results from studies testing the in vivo responses of CD8/Treg ratio in blood, spleen, and tumor.
Figure 65B:
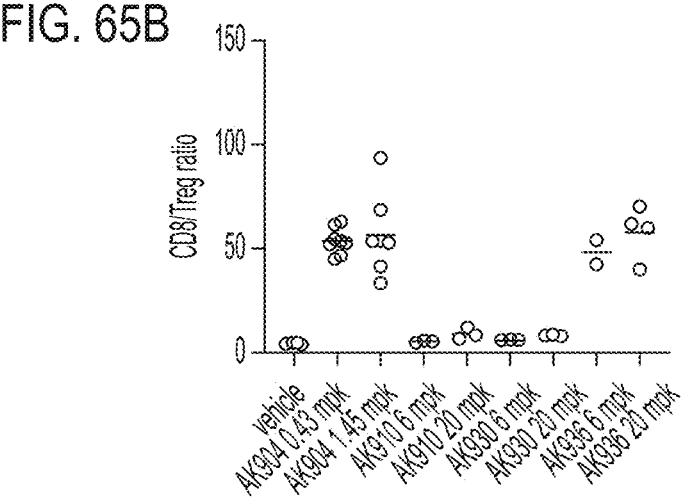

FIGS. 65A and B: Mice treated with AK90 and AK936 demonstrated an increased CD8/Treg ratio in the blood and spleen.

Figure 65C:
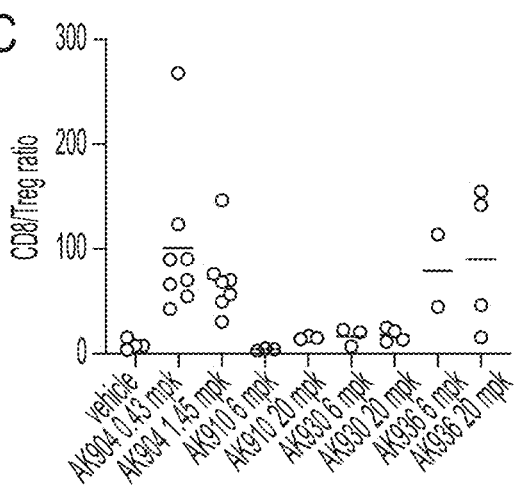

FIG. 65C: Mice treated with AK904, AK930 and AK936 demonstrated a dose-dependent increased CD8/Treg ratio in the tumor.

Example 11

Figure 66:
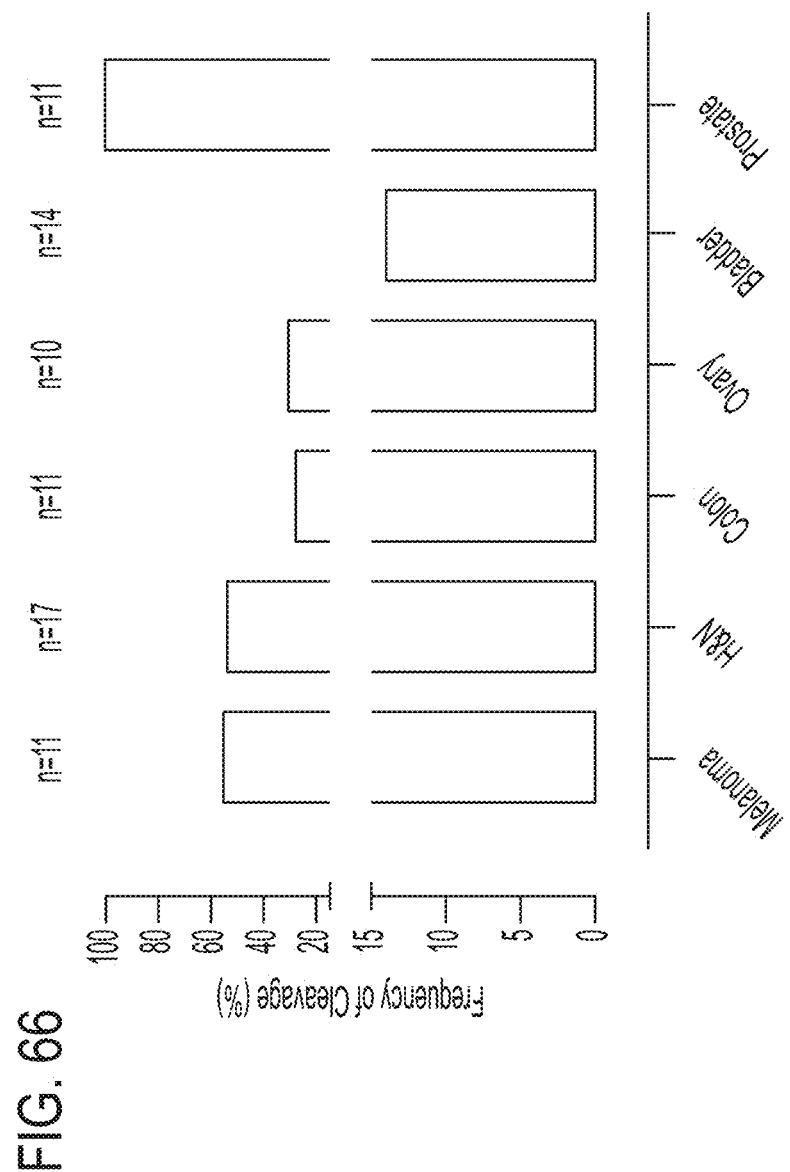
FIG. 66 shows percentage frequency of cleavage in different types of tumor.
Figure 75:
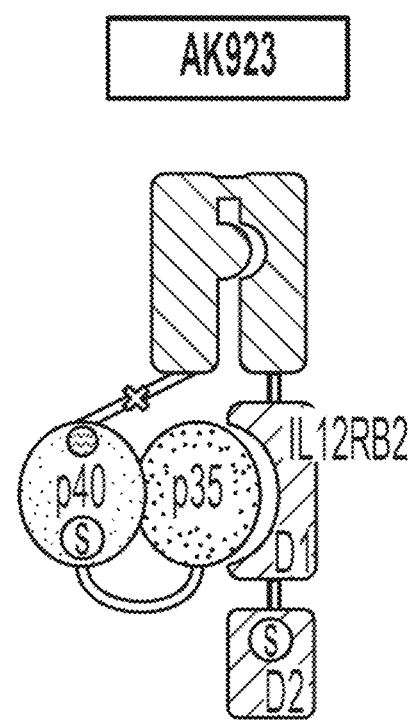
FIG. 75 shows schematic diagram of the construct as used in Example 11.
Figure 76A:
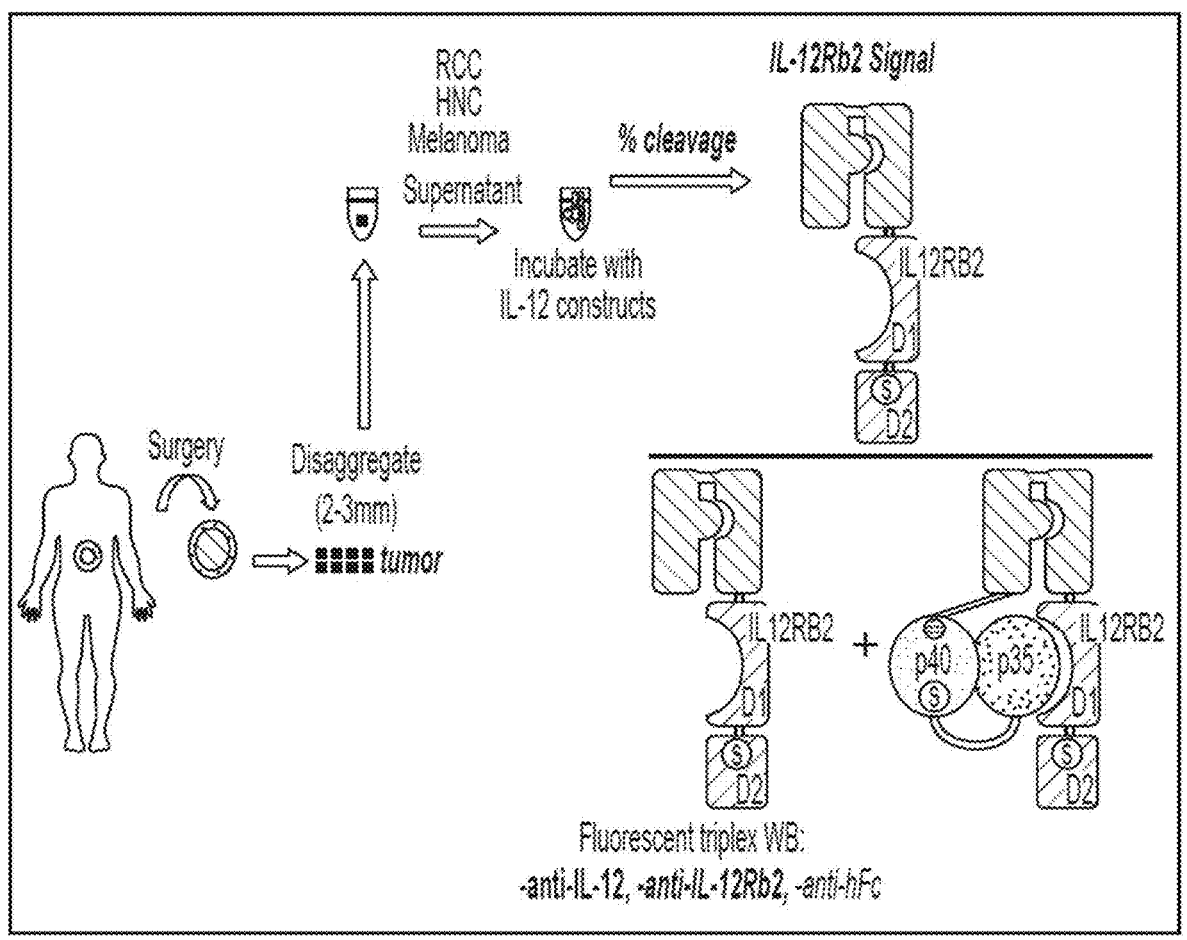
FIG. 76A shows flowchart detailing the process of ex vivo human tumor cleavage assay.

The following construct was used in this Example (FIG. 75):
AK923 (ISSGLLSGRS) IL-12: Ex Vivo Cleavage by Human Tumor The process of ex vivo human tumor cleavage assay is shown in FIG. 76A. Human primary tumor tissues were gently dissociated and culture for 1, 2 or 3 days (500 mg in 30 ml RPMI). Conditioned media (90 μl), containing proteases secreted by the tumor and its microenvironment, was collected for incubation with the AK923 molecules (1 μM) for 24 hours, at 37C. The percentage of cleaved molecule was quantified using the fluorescent triplex western blot. The frequency of cleavage represents the % of tumor samples which were able to cleave the drug. Results are shown in FIG. 66.

Figure 67:
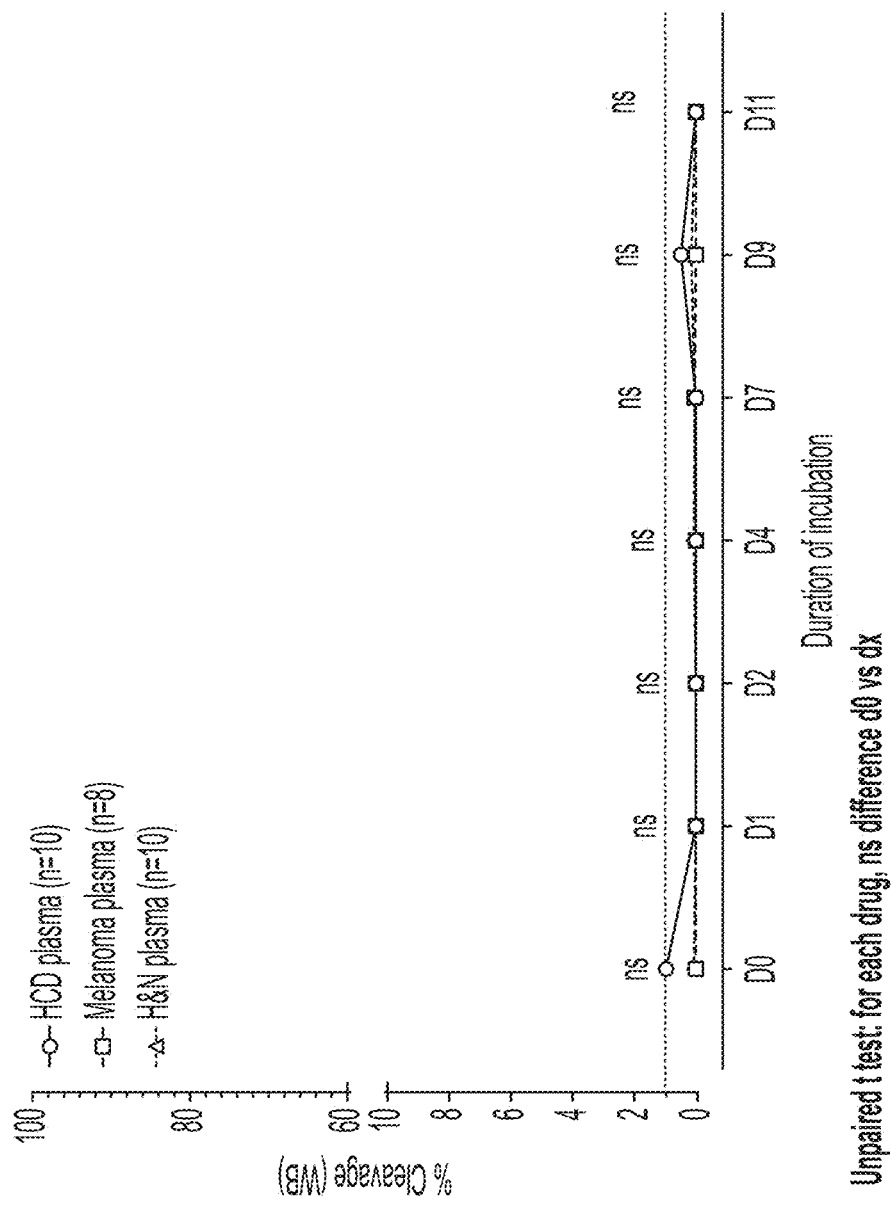
FIG. 67 shows percentage cleavage over time in different plasmas.
Figure 76B:
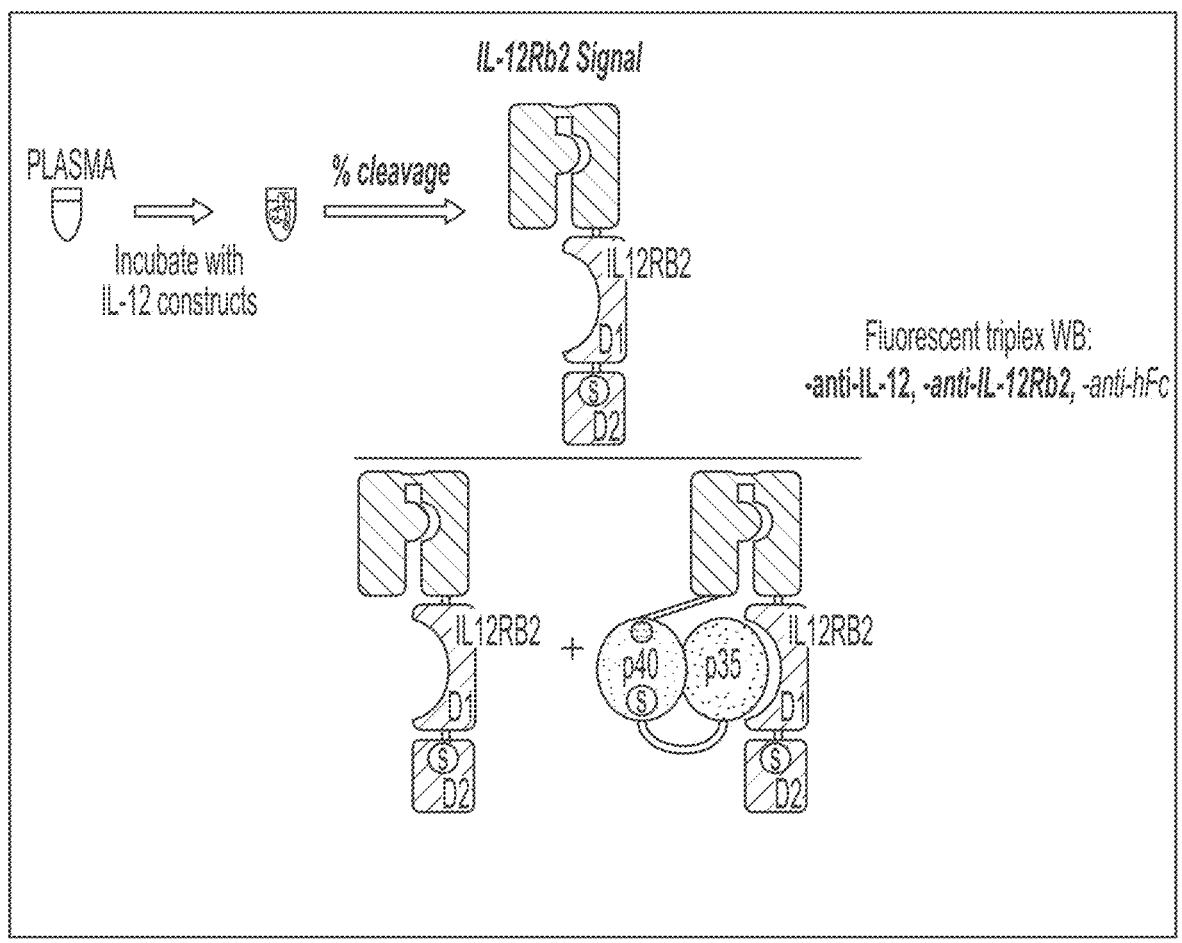
FIG. 76B shows flow-chart for evaluation of AK923 cleavage by various tumor cells.

FIG. 76B shows flow-chart for evaluation of AK923 cleavage by various tumor cells. AK923 drug (1 μM) was incubated in 90 μL of plasma from Healthy human Control Donors (10 donors), Melanoma patients (8 donors) and Head and Neck patients (10 donors), for 1, 2, 4, 7, 9, and 11 days at 37° C. The percentage of cleaved molecule was quantified using the fluorescent triplex western blot. Data points represent the median of 8 or 10 donors. Results are shown in FIG. 67.

The present invention is not intended to be limited in scope to the particular disclosed embodiments, which are provided, for example, to illustrate various aspects of the invention. Various modifications to the compositions and methods described will become apparent from the description and teachings herein. Such variations may be practiced without departing from the true scope and spirit of the disclosure and are intended to fall within the scope of the present disclosure.

10. Sequences

| DESCRIPTION | NEW SEQ ID NO. | Exemplary AK number | AMINO ACID SEQUENCE |
|---|---|---|---|
| IL-2 precursor | 1 | | MYRMQLLSCIALSLALVTNSAPTSSSTKKTQLQLEHLLLDLQMILNGIN NYKNPKLTRMLTFKfYHPKKATELKHLQCLEEELKPLEBVLNLAQSKNF HLRPRDLISNIVIVLELKGSETTYMCEYADETATIVEFLNRWITFCQSI ISTLT |
| IL-2 mature | 2 | | APTSSSTKETQLQLEHLLLDLQMILNGINNYKSPKLTRMLTFKFYMPKK ATELKHLQCLEEETKFLEEVLNLAQSKNFHLRPRDLISNINVIVLELKG SETTFMCEYADETATIVEFLNRWIFCQSIISTLT |
| IL-2 (R38A, F42A, Y45A, E62, C125A) | 3 | AK168<br>AK191<br>AK197<br>AK203<br>AK471<br>AK442<br>AK438<br>AK341<br>AK530<br>AK539<br>AK540<br>AK541<br>AK523<br>AK524<br>AK525 | APTSSSTKKTQLQLEHLLLDLQMILNGINNYKNPKLTAMLTAKFAMPKK ATELRHLQCLEEALKPLEEVLNLAQSKNFHLRPRDLISNINVIVLELKG SETTFMCEYADETATIVEFLNRWITFAQSIISTLT |
| MM | 4 | AK168<br>AK209<br>AK191<br>AK197<br>AK203<br>AK471<br>AK442<br>AK438<br>AK539<br>AK540<br>AK541<br>AK523<br>AK524<br>AK525 | AVSGTSQFTCFYNSRANISCVWSQDGALQDTSCQVHAWPDRRRNNQTCE LLPVSQASWACNLILGAPDSQKLTTVDIVTLRVLCREGVRWRVMAIQDF KPFENLRLMAPISLQVVHVETHRCNISWEISQASHYFERHLEFEARTLS PGHTWEEAPLLTLKQRQEWICLETLTFDTQYEFQVRVKPLQCEFTTWSP WSQPLAFRTKPAALGKD |
| MM (C122S, C168S) | 5 | AK341<br>AK530 | AVNGTSQFTCFYNSRANISCVWSQDGALQDTSCQVHAWPDRRRWNQTCE LLPVSQASWACNLILGAPDSQKLTTVDIVTLRVLCREGVRWRVMAIQDF KPFENLRLMAPISLQVVHVETHRSNISWEISQASHYFERHLEFEARTLS PGHTWEEAPLLTLKQKQEWISLETLTPDTQYEFQVRVKPLQGEFTTWSP WSQPLAFRTKEAALGKD |

-continued

| DESCRIPTION | NEW SEQ ID NO. | Exemplary AK number | AMINO ACID SEQUENCE |
|---|---|---|---|
| Parent IgG1_human heavy chain constant gamma 1 | 6 | | ASTKGPSVFPLAPSSKSTSGGTAALGCLVKDYFPEPVTVSWNSGALTSG VHTFPAVLQSSGLYSLSSVVTVPSSSLGTQTYICNVNHKPSNTKVDKKV EPKSCDKTHTCPPCPAPELLGGPSVFLFPPKPKDTLMISRTPEVTCVVV DSHEDPEVRFNWYVDGVEVHNAKTKPREEQYNSTYRVVSVLTVLEQDN LNGKEYKCKVSNKALPAPIERTISKARCQPRERQVYTLPPSRDELTKNQ VSLTCLKGFYPSDIAVENESNGQPENNYKTTPPVLDSDGSFFLYSKLST VDRSRNQQGNVFSCSVMHEALHNHYTQKSLSLSPGE |
| Parent IgG1_human heavy chain constant gamma 1 - Fc domain | 7 | | DKTATCPPCPAFELLGGPSVFLFPPKEKDTLMISRTPEVTCVWVDVSHE DPEVKFNWYVDGVEVMNAETKEREEQYNSTYRVVSVLTVLHQDWLNGKE YKCKVSNKALPAPTERTISKAEGQEREPQVYTLPPSRDELTKNQVSLTC LVKGFYPSDIAVEWESNGQPENNYKTTPPVLDSDGSFFLYSKLTVDKSR WQQGNVFSCSMNNHEALHNHYTQRSLSLSPG |
| HL1 (Y349C, T366S, L38A, Y407V) | 8 | | DKTHTCPPCPAPELLGGPSVFLFPPKPKDTLMISRTPEVTCVVVDVSHE DPEVKFNWYVDGVEVHNAKTKPREEQYNSTYRVVSVLTVLHQDWLNGKE YKCKVSNKALPAPIEKTISKAKGQPREPQVCTLPPSRDELTKNQVSLSC AVSGFYPSDIAVEWESNGQPENNYKTTPPVLDSDGSFFLSKLTVDKSRW QQGNVFSCSVMHEALHNHYTQKSLSLSPG |
| HL1 (Y349C, T366S, L38A, Y407V, N2972A) | 9 | AK168 AK209 AK191 AK197 AK203 AK442 AK430 AK341 AK530 AK539 AK540 AK541 AK523 AK524 AK525 | DKTHTCPPCPAPELLGGPSVFLFPPKPKDTLMISRTPEVTCVVVDVSHE DPEVKFNWYVDGVEVHNAKTKPREEQYASTYRVVSVLTVLHQDWLNGKE YSCKYSNKALPAPIEKTISKAKGQPREPQVCTLPPSRDELTKNQVSLSC AVKGFYPSDIAVEWESNGQPENNYKTTPPVLDSDGSFFLVSKLTVDKSR WQQGNVFSCSVMHEALHNHYTQRSLSLSPG |
| HL1 (Y349C, T366S, L38A, Y407V, N297A, I253A) | 10 | AK471 | DKTHTCPPCPAPELLGGPSVFLFPPKPKDTLMASRTPEVTCVVVDVSHE DPEVKFNWYVDGVEVHNAKTKPREEQYASTYRVVSVLTVLHQDWLNGKE YKCKVSNKALPAPIEKTISKAKGQPREPQVCTLPPSRDELTKNQVSLSC AVKGFYPSDIAVEWESNGQPENNYKTTPPVLDSDGSFFLVSKLTVDKSR WQQGNVFSCSVMHEALHNHYTQKSLSLSPG |
| HL2 (S354C, T366W) | 11 | | DKTHTCPPCPAPELLGGPSVFLFPPKPKDTLMISRTPEVTCVVVDVSHE DPEVKFNWYVDGVEVHNAKTKPREEQYNSTYRVVSVLTVLHQDWLNGKE YKCKVSNKALPAPIEKTISKAKGQPREPQVYTLPPCRDELTKNQVSLWC LVKGFYPSDIAVEWESNGQPENNYKTTPPVLDSDGSFFLYSKLTVDESR NQQGNVFSCSVMHEALHNRYTQKSLSLSPG |
| HL2 (S354C, T366W, N297A) | 12 | AK168 AK209 AK191 AK197 AK203 AK442 AK438 AK341 AK530 AK539 AK540 AK541 | DKTHTCPPCPAPELLGGPSVFLFPPKPKDTLMISRTPEVTCVVVDVSHE DPEVKFNWYVDGVEVHNAKTKPREEQYASTYRVVSVLTVLHQDWLNGKE YKCKVSNKALPAPIEKTISKAKGQPREPQVYTLPPCRDELTKNQVSLWC LVKGFYPSDIAVEWESNGQPENNYKTTPPVLDSDGSFFLYSKLTVDKSR WQQGNVFSCSVMHEALHNHYTQKSLSLSPG |
| HL2 (S354C, T366W, N297A, I253A) | 13 | AK471 | DKTHTCPPCPAPELLGGPSVFLFPPKPKDTLMASRTPEVTCVVVDVSHE DPEVKFNWYVDGVEVHNAKTKPREEQYASTYRVVSVLTVLHQDWLNGKE YKCKVSNKALPAPIEKTLSKAKGQPREPQVYTLPPCRDELTKNQVSLWC LVKGFYPSDIAVEWESNGQPENNYKTTPPVLDSDGSFFLYSKLTVDRSR WQQGNVFSCSVMHEALHNHYTQKSLSLSPG |

-continued

| DESCRIPTION | NEW SEQ ID NO. | Exemplary AK number | AMINO ACID SEQUENCE |
|---|---|---|---|
| 1st linker (non-cleavable) | 14 | AK168 AK209 AK191 AK197 AK203 AK471 AK341 AK539 AK540 AK541 | PSGS |
| 1st linker L1 (cleavable) | 15 | AK442 | GGPSGSSPGDSGGFMLTSGGG |
| 1st linker L1 (cleavable) | 16 | AK438 | GPPSGSSPGVPLSLYGSGGG |
| 1st linker L1 (cleavable) | 17 | AK530 | GPPSGSSPMPYDLYHPSGG |
| 1st linker L1 (cleavable) | 242 | AK523 | GSPDLLAVVAASSGP |
| 1st linker L1 (cleavable) | 243 | AK524 | GSPGDLLAVVAASSGP |
| 1st linker L1 (cleavable) | 244 | AK525 | GSGSPSDLLAVVAASSGP |
| 2nd linker L2 (cleavable) | 18 | AK168 | GGSSPPMPYDLYHPSGP |
| 2nd linker L2 (cleavable) | 19 | AK209 AK471 AK341 | GSPGVPLSLYSGP |
| 2nd linker L2 (cleavable) | 20 | AK191 | GGSGRAAAVKSPSGP |
| 2nd linker L2 (cleavable) | 21 | AK197 | GGSGHEQLTVSGP |
| 2nd linker L2 (cleavable) | 22 | AK203 | GSGPDSGGFMLTSGP |
| 2nd linker L2 (non-cleavable) | 23 | AK442 AK438 AK530 AK523 AK524 AK525 | GGSSPPGGGSSGGGSGP |
| 2nd linker L2 (cleavable) | 245 | AE539 | GGPSDLLAVVAASSGP |
| 2nd linker L2 (cleavable) | 246 | AK540 | GSGPSDLLAVVAASSGP |
| 2nd linker L2 (cleavable) | 247 | AK541 | GSSGGPDLLAVVAASSGP |
| Cleavable peptide | 24 | AK16B AK530 | MPYD*LYHP *indicates cleavage site |

-continued

| DESCRIPTION | NEW SEQ ID NO. | Exemplary AK number | AMINO ACID SEQUENCE |
|---|---|---|---|
| Cleavable peptide | 25 | AK203<br>AK442 | DSCG*FMLT<br>*indicates cleavage site |
| Cleavable peptide | 26 | AK197 | HEQ*LTV<br>*indicates cleavage site |
| Cleavable peptide | 27 | AK191 | RAAA*VKSP<br>*indiCates cleavage site |
| Cleavable peptide | 28 | AK209<br>AK471<br>AK341<br>AK438 | VPLS*LY<br>*indicates cleavage site |
| Cleavable peptide | 248 | AK50<br>AK539<br>AK540<br>AK541<br>AK523<br>AK524<br>AK525 | DLLA*VVAAS<br>*indicates cleavage site |
| Cleavable peptide | 249 | AK88 | I*SSG*LLSGRS<br>*indicates cleavage site |
| C terminal spacer domain | 29 | AK168<br>AK209<br>AK191<br>AK197<br>AK203<br>AK471<br>AK348<br>AK539<br>AK540<br>AK541<br>AK523<br>AK524<br>AK525 | SGP |
| C terminal spacer domain | 30 | AK442<br>AK530 | SGGG |
| C terminal spacer domain | 31 | AK438 | GSGGG |
| N terminal spacer domain | 32 | AK168 | GGSSPP |
| N terminal spacer domain | 33 | AK203 | GSGP |
| N terminal spacer domain | 34 | AK209<br>AK341<br>AK471<br>AK524 | GSPG |
| N terminal spacer domain | 35 | AK191<br>AK197 | GGSG |
| N terminal spacer domain | 36 | AK442<br>AK348 | GPPSGSSPG |
| N terminal spacer domain | 37 | AK530 | GPPSGSSP |
| N terminal spacer domain | 250 | AK539 | GGPS |

| DESCRIPTION | NEW SEQ ID NO. | Exemplary AK number | AMINO ACID SEQUENCE |
|---|---|---|---|
| N terminal spacer domain | 251 | AK540 | GSGPS |
| N terminal spacer domain | 252 | AK541 | GSSGGP |
| N terminal spacer domain | 253 | AK523 | GSP |
| N terminal spacer domain | 254 | AK525 | GSGSPS |
| 1st polypeptide chain - A (HL1-L1-MM) | 38 | AK168 AK192 AK197 AK203 AK209 AK539 AK540 AK541 | DKTRTCPPCPAPELLGGESVFLFPPKPKDELMLSRTPEVTCVVVDVSHE DPEVKFNWYVDGVEVHNAKTKPREEQYASTYRWVSVLTVLHQDWLNGKE YKCKVSNKALPAPLERTLSKAKGZPREPQVCTLPPSRDELTKNQVSLSC AVKGFYPSDIAVENESNGQPENNYKTTPPVLDSDGSFFLVSKLTVDKSR WQQGNVFSCSVMHEALHNHYTQKSLSLSPGPGSGSAVNGTSQFTCEYNS EANISCVWSQDGALQDPSCQVHAWPDRRRNNQTCELLPVSQASWACNLI LGAPDSQKLTTVDIVTLRVLGREGVRWRVMAIQDFSPFENLRLMAPISL QVVHVETERCNISWEISQASHYFERHLEFEARTLSPGHTKEEAPLLTLR QKQEWICLETLPDTQYEFQVRVKPLQGEFTTWSPWSQPLAFRTRPAALG KD |
| 1st polypeptide chain - B (HL1-L1-MM) | 39 | AK341 | DKTHTCPPCPAPELLGGPSVFLFPPKPKDTLMISRTPEVTCVVVDVSHE DPEVKFNWYVDGVEVHNAKTEPREEQYASTYRVVSVLTVLHQDWLSGKE YKCRVSNSALPAPIEKTISKAKGQPREPQVCTLPPSRDELTKNQVSLSC AVKGFYPSDIAVEWESNGQPENNYKTTPRVLDSDSSFFLVSKLTVDKSR WQQGNVFSCSVMHEALHNHYTQKSLSLSPGPGSGSAVNGTSCFTCFYNS RANISCVWSQDGALQDTSCQVHAWPDRRRWNQTCELLPVSQASWACNLI LGAPDSQKLTTVDIVTLRVLCREGVRWRVMAIQDFKPFENLRLMAPISL QVVHVETHRSNISWEISQASHYFERHLEFEARTLSPGHTWEEAPLLTLR QKQEWISLETLTPDTQYEFQVRVKPLQGEFTTWSPWSQPLAFRTKPAAL GKD |
| 1st polypeptide chain - C (HL1-L1-MM) | 40 | AK530 | DKTHTCPPCPAPELLGGPSVFLFPPKPKDTLMISRTPEVTCVVVDVSHE DPEVKFSWYVDGVEVBNAKTKFRSSQVASTYRWSVLTVLHQDWLEGKE YKCKVSNKALPAPIEKTISKAKGQFEEPQVCTLPFSRDSLYKNQVSLSC AVKSFYPSDIAVREWESNGQPENNYKTTPPVLDSDGSFFLVSKLTVDKS RWQQGNVFSCSVMHEALHNHYTQKSLSLSPGGPPSGSSPMPYDLYHPSG GGAVNGTSQFTCFYNSRANISCVWSQDGALQDTSCQVHAWPDRRRWNQT CELLPVSQASWANLILGAPDSQKLTTVDIVTLRVLCREGVRWRVMAIQD FKPFENLRLMAPISLQVVHVETHRSNISWEISQASHYFERHLEFEARTL SPGHTKEEAPLLTLKQKQEWISLETLTPDTQYEFQVRVKPLGGEFTTWS FWSQPLAFRTKPAALGKD |
| 1st polypeptide chain - D (HL1-L1-MM) | 41 | AK442 | DKTHTCPPCPAPELLGGPSVFLFPPKPKDTLMISRTPEVTCVVVDVSHE DPEVKNWTVDGVEVHNAKTKPREEQYASTYRVVSVLTVLHQDWLNGKEY KCKVSNKALPAPIEKTISKAKGQPREPQVCTLPPSRDELTKNQVSLSCA VKGFYPSDIAVEWESNGQPENNYKTTPPVLDSDGSFFLVSKLTVDKSKW QQGNVFSCSVMHEALHNHYTQKGLSLSPGGPPSGSSFGDSGGFHLTSGG GAVNGTSQFTCFYNSRANISCVWSQDGALQDTSCQVHANPDRRRWNQTC ELLPVSQASWACNLILGAPDSQKLTTVDIVTLRVLCREGVRWRVMAIQD FKPTENLRLMAPISLQVVHVETNRCNISWEISQASHYFERHLEFEARTL SPGHTWEEAPLLTLKQKQEWICLETLPDTQYEFQVRVKPLQGEFTTWS PWSQPLAFRTKPAALGKD |
| 1st polypeptide chain - E (MLI-L1-MM) | 42 | AK438 | DKTATCPPCPAPELLGGPSVELEPPKPKDTLMISRTPEVTCVVVDVSHE DPEVKENWYVDGVEVANAKTKPREEQYASTYRVVSVLTVLHQDWLNGKE YKCKVSNKALPAPIEKTISKAKGQPREPQVCTLPPSRDELTKNQVSLSC AVKGEYPSDIAVEWESNGGPENNYKTTPPVLDSDGSFFLVSKLTVDKSR WQQGNVFSCSVMHEALHNHYTQKSLSLSPGGPPSGSSPGVPLSLYGSGG GAVNGTSQFTCYYNSRANISCVWSQDGALQDTSCQVHAWPDERRRWNQT CELLPVSQASWACNLILGAPDSQKLTTVDIVTLRVLCREGVRWRVMAIQ DFKPFENLRLMAPISLQVVHVETHRCNISWEISQASHYFERHLEFEART LSPGHTWEEAPLLTLKQKQEWICLETLPDTQYEFQVRVKPLQGEFTTW SPWSQPLAFRTKPAALGKD |
| 1st polypeptide chain - G (HL-L2-C) | 43 | AK471 | DKTHTCPPCPAPELLGGPSVFLFPPKPKDTLMASRTPEVTCVVVDVSHE DPEVKFNWYVDGVEVHNAKTKPREEQYASTYRVVSVLTVLHQDWLNGKE YKCKVSNKALPAPIEKTISKAKGQPREPQVCTLPPSDELTKNQVSLSC AVKGFYPSDIAVEWESNGQPENNYKTTPPVLDSDGSFFLSKLTVDKSRW |

| DESCRIPTION | NEW SEQ ID NO. | Exemplary AK number | AMINO ACID SEQUENCE |
|---|---|---|---|
| | | | QQGNVFSCSVMHEALHNHYTQKSLSLSPGPGSGSAVNGTSQFTCFYNSR ANISCVNSQDGALQDTSCQVHAWPDRRRWNQTCELLPVSQASWACNLIL GAPDSQKLTTVDIVTLRVLCREGVRNRVMAIQDFKPFENLRLMGAPISL QVVHVETHRCNISWEISQASHYFERHLEFEARTLSPGHTWEEAPLLTLK QKQEWICLETLTPDTQYEFQVRVKPLQGEFTTWSPWSQPLAFRTKPAAL GKD |
| 1st polypeptide chain - H (HL-L2-C) | 44 | AK252 | DKTRTCPPCPAPELLGGPSVELEPPKPKDTLMISRTPEVTCVVVDVSHE DPEVKFNWYVDGVEVHNAKTKPREEQYASTYRVVSVLTVLHQDWLNGKE YKCKVSNNALPAPIEKTISKAKGQPREPQVCTLPPSRDELTKNQVSLSC AVKGFYPSDIAVEWESNGQPENNYKTTPPVLDSDGSFFLVSKLTVDKSR WQQGNVFSCSVMHEALHNHYTQKSLSLSPGGPPSGSSPMPYDLYHPSGG GAVNGTSQFTCFYSRANISCVWSQDGALQDTSCQVHAWPDRRRWNQTCE LLPVSQASWACNLILGAPDSQKLTTVDIVTLRVLCREGVRWRVMAIQDF KPFENLRLMAPISLQVVHVETHRCNISWEISQASHYFERHLEFEARTLS PGHTWEEAPLLTLKQKQEWICLETLTPDTQYEFQVRVKPLQGEFTTWSP NSQPLAFRTKPAALGKD |
| 1st polypeptide chain - I (HL-L1-2M) | 255 | AK523 | DKTHTCPPCPAPELLGGPSVELFPPKPKDTLMISRTPEVTCVVVDVSRE DPEVKFNWYVDGVEVANAKTKPREEQYASTYRVVSVLTVLHQDWLNGKE YKCKVSNKALPAPIEKTISKAKGQPREPQVCTLPPSRDELTENQVSLSC AVKGFYPSDIAVEWESNGQPENNYKTTPPVLDSDGSEFLVSKLTVDESR WQCGNVFSCSVMNEALANHYTQKSLSLSPGGSPDLLAVVAASSGPAVNI GTSQFTCFYHSRANISCVWSQDGALCDTSCQVHAWPDRRRWNQTCELLP VSQASWACNLILGAPDSQELTTVDIVTLRVLCREGVRWRVMAIQDFKPF ENLRLMAPISLQVVHVETHRCNISWEISQASHYFERHLEFEARTLSPGH TWEEAPLLTLKQKQEWICLETLTPDTQYEFQVRVKPLQGEFTTWSPWSQ PLAFRTKPAALGKD |
| 1st polypeptide chain - J (HL-11-2M) | 256 | AK524 | DKTHTCPPCPAPELLGGPSVFLFPPKPSDTLMISRTPEVTCVVVDVSHE DPEVKFNWYVDGVEVHNAKTKPREEQYASTYRVVSVLTVLHQDWLNGKE YKCKVSNKALPAPIEKTISKARCQPREPQVCTLPPSRDELTKNQVSLSC AVKGFYPSDIAVEWESNGQPENNYKTTPPVLDSDGSFFLVSKLTVDKSR WQQGNVFSCSVMHEALHNHYTQKSLSLSPGGSPGDLLAVVAASSGPAVN GTSQFTCFYNSRANISCVWSQDGALQDTSCQVHAWPDRRRWNQTCELLP VSGASWACNLILGAPDSQKLTTVDIVTLRVLCREGVRWRVMAIQDFKPF ENLRLMAPISLQVVHVETHRCNISWEISQASHYFERHLEFEARTLSPGH TWEEAPLLTLKQKEWICLETLTPDTQYEFQVRVKPLQGEFTTQSPWSQP LAFRTKPAALGKD |
| 1st polypeptide chain - K (HL-L1-MM) | 257 | AK525 | DKTHTCPPCPAPELLGGPSVFLFPPKPKDTLMISRTPEVTCVVVDVSHE DPEVKFNWYVDGVEVHNAKTKPREEQYASTYEVYSVLTVLHQDWLNGKE YKCRVSNEALPAPIEKTISKAKGQPREPQVCTLPPSRDELTKNQVSLSC AVKGFYPSDIAVEWESNGQPENNYKTTPPVLDSDGSFFLVSKLTVDKSR WQQGNVFSCSVMHEALHNHYTQKSLSLSPGGSPSDLLAVVAASSGPAV NGTSQFTCFYNSRANISCVNSQDGALQDTSCQVHAWPDRRRWNQTCELL PVSQASWACNLILGAPDSQKLTTVDIVTLRVLCREGVRWRVMAIQDFRP FENLRLMAPISLQVVHTEHRCNISWEISQASHYFERHLEFEARTLSPGH TWEEAPLLTLKQKQEWICLETLTPDTQYEFQVRVKPLQGEFTTWSPWSQ PLAFRTKPAALGKD |
| 2nd polypeptide chain - A (HL-L2-C) | 45 | AK168 | DKTHTCPPCPAPELLGGPSVFLFPPKPKDTLMISRTPEVTCVVVDVSHE DPEVKFNWYVDGVEVHNAKTKPREEQYASTYRVVSVLTVLHQDWLNGKE YKCKVSNKALPAPIEKTISKAKGQPREPQVYTLPPCRDELTKNQVSLWC LVKGFYPSDIAVEWESNGQPENNYKTTPPVLDSDGSFFLYSKLTVDKSR WQQGNVFSCSVMHEALHNHYTQKSLSLSPGGGSSPPMPYDLYHPSGPAP TSSSTKKTQLQLEHLLLDLQMILNGINNYKNPKLTAMLTAKFAMPKKAT ELKHLQCLEEALKPLEEVLNLAQSKNFHLRPRDLISNINVIVLELKGSE TTFMCEYADETATIVEFLNRWITFAQSIISTLT |
| 2nd polypeptide chain - B (HL-L2-C) | 46 | AK191 | DKTHTCPPCPAPELLGGPSVFLFPPKPKDTLMISRTPEVTCVVVDYSHE DPEVKFNWYVDGVEVHNAKTKPREEQYASTYRVVSVLTVLHQDWLNGKE YKCKVSNKALPAPIEKTISRAKGQPREPQVYTLPPCRDELTKNQVSLWC LVKGFYPSDIAVEWESNGQPENNYKTTPPVLDSDGSFFLYSKLTVDKSR WQQGNVFSCSVMHEALHNHYTQKSLSLSPGGGSGRAAAVKSPSGPAPTS SSTKKTQLQLEHLLLDLQMILNGINNYKNPKLTAMLTAKFAMPKKATEL KHLQCLEEALKPLEEVLNLAQSKNFHLRPRDLISNINVIVLELKGSETT FMCEYADETATIVEFLNRWITFAQSIISTLT |

| DESCRIPTION | NEW SEQ ID NO. | Exemplary AK number | AMINO ACID SEQUENCE |
|---|---|---|---|
| 2<sup>nd</sup> polypeptide chain - C (HL-L2-C) | 47 | AK197 | DKTHTCPPCPAPELLGGPSVFLFPPKPKDTLMISRTPEVTCVVVDVSHE DPEVKFNWYVDGVEVHNAKTKPREEQYASTYRVVSVLTVLHQDWLNGKE YKCKVSNKALPAPIEKTISKAKGQPREPQVYTLPPCRDELTKNQVSLWC LVKGFYPSDIAVEWESNGQPENNYKTTPPVLDSDGSFFLYSKLTVDKSR WQQGNVFSCSVMHEALHNHYTQKSLSLSPGGGSGHEQLTVSGPAPTSSS TKKTQLQLEHLLLDLQMLINGINNYKNPKLTAMLTAKFAMPKKATELKH LQCLEEALKPLEEVLNLAQSKNFHLRPRDLISNINIVIVLELKGSETTFM CEYADETATIVEFLNRWITFAQSIISTLT |
| 2<sup>nd</sup> polypeptide chain - D (HL-L2-C) | 48 | AK203 | DKTHTCPPCPAPELLGGPSVFLFPPKPKDTLMISRTPEVTCVVVDVSHE DPEVKFNWYVDGVEVHNAKTKPREEQYASTYRVVSVLTVLHQDWLNGKE YKCKVSNKALPAPIEKTISKAKGQPREPQVYTLPPCRDELTKNQVSLWC LVKGFYPSDIAVEWESNGQPENNYKTTPPVLDSDGSFFLYSKLTVDKSR WQQGNVFSCSVMHEALHNHYTQKSLSLSPGGSGPDSGGFMLTSGPAPTS SSTKKTQLQLEMLLLDLGMILNGINNYKNPKLTAMLTAKFAMPKKATEL KHLQCLEEALKPLEEVLNLAQSKNFHLRPRDLISNINIVIVLELKGSETT FMCEYADETATIVEFLNRWITFAQSIISTLT |
| 2<sup>nd</sup> polypeptide chain - E (HL-L2-C) | 49 | AK209 AK341 | DKTHTCPPCPAPELLGGPSVFLFPPKPKDTLMISRTPEVTCVVVDVSHE DPEVKFNWYVDGVEVHNAKTKPREEQYASTYRVVSVLTVLHQDWLNGKE YKCKVSNKALPAPIERTISKAKGQPREPQVYTLPPCRDELTKNQVSLWC LVKGFYPSDIAVEWESNGQPENNYKTTPPVLDSDGSFFLYSKLTVDKSR WQQGNVFSCSVMHEALHNHYTQKSLSLSPGGSPGVPLSLYSGPAPTSSS TRKTQLQLEHLLLDLQMILNGINNYKNPKLTAMLTAKFAMPKKATELKH LQCLEEALKPLEEVLNLAQSKNFHLRPRDLISNINIVIVLELKGSETTFM CEYADETATIVEFLNRWITFAQSIISTLT |
| 2<sup>nd</sup> polypeptide chain - F (HL-L2-C) | 50 | AK471 | DKTHTCPPCPAPELLGGPSVFLFPPKPKDTLMASRTPEVTCVVVDVSHE DPEVKFNWYVDGVEVHNAKTKPREEQYASTYRVVSVLTVLHQDWLNGKE YKCKVSNKALPAPIEKTISKAKGQPREPQVYTLPPCRDELTKNQVSLWC LVKGFYPSDIAVEWESNGQPENNYKTTPPVLDSDGSFFLYSKLTVDRSR WQQGNVFSCSVMHEALHNHYTQKSLSLSPGGSPGVPLSLYSGPAPTSSS TKKTQLQLEHLLLDLQMILNGINNYKNPKLTAMLTAKFAMPKKATELKH LQCLEEALKPLEEVLNLAQSKNFHLRPRDLISNINIVIVLELRGSETTFM CEYADETATIVEFLNRWITFAQSIISTLT |
| 2<sup>nd</sup> polypeptide chain - G (HL-L2-C) | 51 | AK442 AK438 AK530 AK252 AK523 AK524 AK525 | DKTHTCPPCPAPELLGGPSVFLFPPKPKDTLMISRTPEVTCVVVDVSHE DPEVKFNWYVDGVEVHNAKTKPREEQYASTYRVVSVLTVLHQDWLNGKE YKCKVSNKALPAPIEKTISKAKGQPREPQVYTLPPCRDELTKSQVSLWC LVKGFYPSDIAVEWESNGQPENNYKTTPPVLDSDGSFFLYSKLTVDKSR WQQGNVFSCSVMHEALHNHYTQKSLSLSPGGGSSPPGGGSSGGGSGPAP TSSSTKKTQLQLEHLLLDLQMILNGINNYKNTKLTAMLTAKFAMPKKAT ELKHLQCLEEALKPLEEVLNLAQSKNFHLRPRDLISNINIVIVLELKGSE TTFMCEYADETATIVEFLNRWITFAQSIISTLT |
| 2<sup>nd</sup> polypeptide chain - H (HL-L2-C) | 258 | AK539 | DKTHTCPPCPAPELLGGPSVFLFPPKPKDTLMISRTPEVTCVCCDVSHE DPEVKFNWYVDGVEVHNAKTKPREEQYASTYRVVSVLTVLHQDWLNGKE YCKVSNKALPAPIEKTISKAKGQPREPQVYTLPPCRDELTKNQVSLWCL VKGFYPSDIAVEWESNGQPENNYKTTPPVLDSDGSFFLYSKLTVDRSRW QQGNVFSCSVMHEALHNHYTQKSLSLSPGGGPSDLLAVVAASSGPAPTS SSTKKTQLQLEHLLLDLQMILNGINNYKNPKLTAMLTAKFAMPKKATEL KHLQCLEEALKPLEEVLNLAQSKNFHLRPRDLISNINIVIVLELKGSETT FMCEYADETATIVEFLNRWITFAQSIISTL |
| 2<sup>nd</sup> polypeptide chain - H (HL-L2-C) | 259 | AK540 | DKTHTCPPCPAPELLGGPSVFLFPPKPKDTLMISRTPEVTCVVVDVSHE DPEVKFNWYVDGVEVHNAKTKPREEQYASTYRVVSVLTVLHQDWLNGKE YKCKVSNKALPAPIEKTISKAKGQPREPQVYTLPPCRDELTKNQVSLWC LVKGFYPSDIAVEWESNGQPENNYKTTPPVLDSDGSFFLYSKLTVDKSR WQQGNVFSCSVMHEALHNHYTQKSLSLSPGGSGPSDLLAVVAASSGPAP TSSSTKKTQLQLEHLLLDLQMILNGINNYKNPRLTAMLTAKFAMPKKAT ELKHLQCLEEALKPLEEVLNLAQSKNFHLRPRDLISNINIVIVLELKGSE TTFMCEYADETATIVEFLNRWITPAQSIISTLT |
| 2<sup>nd</sup> polypeptide chain - H (HL-12-c) | 260 | AK541 | DKTHTCPPCPAPELLGGPSVFLFPPKPKDTLMISRTPEVTCVVVDVSHE DPEVKFNWYVDGVEVHNAKTKPREEQYASTYRWVSVLTVLHQDWLNGKE YKCKVSNKALPAPIEKTISKAKGQPREPQVYTLPPCRDELTKNQVSLWC LVKGFYPSDIAVEWESNGQPENNYKTTPPVLDSDGSFFLYSKLTVDKSR WQQGNVFSCSVMHEALHNHYTQKSLSLSPGGSGGFDLLAVVAASSGPA PTSSSTKKTQLQLEHLLLDLQMILNGINNYKNPKLTAMLTAKFAMPKKA TELKHLGCLEEALKPLEEVLSLAQSKNTHLRPRDLISNINIVIVLELKGS ETTFMCEYADETATIVEFLNRWITFAQSIISTLT |
| Cleavage product CP | 52 | AK168 | LYHPSGPAPTSSSTKKTQLQLEHLLLDLQMILNGINNYKNPKLTAMLTA KFAMPKKATELKHLQCLEEALKPLEEVLNLAQSKNFHLRPADLISNINV IVLELKGSETTFMCEYADETATIVEFLNRWITFAQSIISTLT |

-continued

| DESCRIPTION | NEW SEQ ID NO. | Exemplary AK number | AMINO ACID SEQUENCE |
|---|---|---|---|
| Cleavage product CP | 53 | AK191 | VKSPSGPAPTSSSTKKTQLQLEHLLLDLQMILSGINNYKNPKLTAMLTA KFAMPKKATELKHLQCLEEALKPLEEVLNLAQSKNFHLRPRDLISNINV IVLELKGSETTTMCEYADETATIVEFLNRWITFAQSIISTLT |
| Cleavage produCt CP | 54 | AK197 | LYVSGPAPTSSSTKKTQLQLEHLLLDLQMILNGINNYKNPKLTAMLTAK FAMPKKATELKHLQCLEEALKPLEEVLNLAQSKNFHLRPRDLISNINVI VLELKGSETTFMCEYADETATIVEFLNRWITFAQSIISTLT |
| Cleavage produCt CP | 55 | AK203 | FMLTSGPAPTSSSTKKTQLQLEHLLLDLQMILNGINNYKNPKLTAMLTA KFAMPKKATELKHLQCLEEALKPLEEVLNLAQSKNFHLRPRDLISNINV IVLELKGSETTFMCEYADETATIVEFLNRWITFAQSIISTLT |
| Cleavage product CP | 56 | AK209 AK341 AK471 | LYSGPAPTSSSTKKTQLQLEHLLLDLQMILNSGINNYKNPKLTAMLTAK FAMPKKATELKHLQCLEEALKPLEEVLNLAQSKNFHLRPRDLISNINVI VLELKGSETTFMCEYADETATIVEFLARWITFAQSIISTLT |
| Cleavage product CP | 57 | AK442 | DKTHTCPPCPAPELLGGPSVELFPPKPEDTLMISRTPEVTCVVVDVSHE DPEVKFNWYVDGVEVHNAKTKPREEQYASTYRVVSVLTVLHQDSLSGKE YKCKVSNSALPAPIEKTLSKAKCQPREPQVYTLPPCRDELTKNGVSLWC LVKGFYPSDIAVEWESNGQPENNYKTTPPVLDSDGSFFLYSKLTVDKSR WQQGNVFSCSVMHEALRNRYTOKSLSLSPGGGSSPPGGGSSGGGSGPAP TSSSTKKTQLQLEHLLLDLQMILNGINNYKNPKLTAMLTARFAMPKKAT ELKHLQCLEEALKPLEEVLNLAQSKNFALRPRDLISNINVIVLELKGSE TTFMCEYADETATIVEFLNRWITFAQSIISTLT; (2nd polypeptide chain - SEQ ID NO: 265) <br><br> DKTHTCPPCPAPELLGGPSVFLFPPKPKDTLMISRTPEVTCVVVDVSHE DPEVKFNWYVDGVEVHNAKTKPREEQYASTYRVVSVLTVLHQDWLNGKE YKCKVSNKALPAPIEKTTSKAKGQPREPQVCTLPPSRDELTKNQVSLSC AVKGFYPSDIAVEWESNGQPENNYKTTPPVLDSDGSFFLVSKLTVDKSR WQQGNVFSCSVMNEALHNHYTQKSLSLSPGGPPSGSSPGDSGG (1st polypeptide chain - SEQ ID NO: 266) |
| Cleavage product CP | 58 | AK438 | DKTHTCPPCPAPELLGGPSVFLFPPKPKDTLMISRTPEVTCVVVDVSHE DPEVKFNWYVDGVEVHNAKTKPREEQYASTYRVVSVLTVLHQDWLNGKE YKCKVSNKALPAPIEKTISKAKGQPREPQVYTLPPCEDELTKNQVSLWC LVKGFYPSDIAVEWESNGQPENNYKTTPPVLDSDGSFFLYSKLTVDKSR WQQGNVFSCSVMHEALHNHYTQKSLSLSPGGGSSPPGGGSSGGGSGPAP TSSSTKKTQLQLEHLLLDLQMILNGINNYKNPKLTAMLTAKFAMPKKAT ELKHLQCLEEALKPLEEVLNLAQSKNTHLRPRDLISNINVIVLELKGSE TTEMCEYADETATIVEFLNRWITFAQSIISTLT; (2nd polypeptide chain - SEQ ID NO: 267) <br><br> DKTHTCPPCPAPELLGGRSVFLFPPKPKDTLMISRTPEVTCVVVDVSHE DPEVKFNWYVDGVEVHNAKTKPREEQYASTYRVVSVLTVLHQDWLNGKE YKCKVSNKALPAPIEKTISKAKGQPREPQVCTLPPSRDELTKNQVSLSC AVKGFYPSDIAVEWESNGQPENNYKTTPPVLDSDGSFFLVSKLTVDKSR WQQGNVFSCSVMHEALHNHYTQKSLSLSPGSPPSGSSPGVPLS (1st polypeptide chain - SEQ ID NO: 268) |
| Cleavage product CP | 59 | AK530 | DKTHTCPPCPAPELLGGPSVFLFPPKPKDTLMISRTPEVTCVVVDVSHE DPEVKFNWYVDGVEVHNAKTKPREEQYASTYRVVSVLTVLHQDWLNGKE YKCKVSNKALPAPIEKTISKAKGQPREPQVYTLPPCRDELTKNQVSLWC LVKGFYPSDIAVEWESNGQPENNYKTTPPVLDSDGSFFLYSKLTVDKSR WQQGNVFSCSVMHEALHNHYTQKSLSLSFGGGSSPPGGGSSGGGSGPAP TSSSTKKTQLQLEHLLLDLGMILNGINNYKNPKLTAMLTAKFAMPKKAT ELKHLQCLEEALKPLEEVLNLAQSKNFHLRPRDLISNINVIVLELKGSE TTFMCEYADETATIVEFLKRWITFAQSIISTLT; (2nd polypeptide chain - SEQ ID NO: 269) <br><br> DKTHTCPPCPAPELLGGPSVFLFPPKPKDTLMISRTPEVTCVVVDVSHE DPEVKFNWYVDGVEVHNAKTKPREEQYASTYRVVSVLTVLHQDWLNGKE YKCKVSNKALPAPIEKTISKAKGQPREPQVCTLPPSRDELTKNQVSLSC AVKGFYPSDIAVEWESNGQPENNYKTTPPVLDSDGSFFLVSKLTVDKSR WQQGNVFSCSVMHEALHNHYTQKSLSLSPGGPPSGSSPMPYD (1st polypeptide chain - SEQ ID NO: 270) |
| Cleavage product CP | 261 | AK539 AK540 AK541 | VVAASSGPAPTSSSTKKTQLQLEHLLLDLQMILKGINNYKNPKLTAMLT AKFAMPKKATELKHLQCLEEALKPLEEVLNLAQSKHFHLRPRDLISNIN VIVLELKGSETTFMCEYADETATIVEFLNRWITFAQSIISTLT |
| Cleavage product CP | 262 | AK523 | DKTHTCPPCPAPELLGGPSVFLFPPKPKDTLMISRTPEVTCVVVDVSHE DPEVKFNWYVDGVEVHNAKTKPREEQYASTYRVVSVLTVLHQDWLNGKE YKCKVSNKALPAPIEKTISKAKGQPREPQVYTLPPCRDELTKNQVSLMC LVKGFYPSDIAVEWESNGQPENNYKTTPPVLDSDGSFFLYSKLTVDKSR WQQGNVFSCSVMHEALHNHYTQKSLSLSPGGGSSPPGGGSSGGGSGPAP |

| DESCRIPTION | NEW SEQ ID NO. | Exemplary AK number | AMINO ACID SEQUENCE |
|---|---|---|---|
| | | | TSSSTKKTQLQLEHLLLDLQMILNGINNYKNPKLTAMLTAKFAMPKKAT ELKHLQCLEEEALKPLEEVLNLAQSKNFHLRPRDLISNINVIVLELKGSE TTFMCEYADETATIVEFLNRWITFAQSIISTLT (2$^{nd}$ polypeptide chain - SEQ ID NO: 271) |
| | | | DKTHTCPPCPAPELLGGPSVFLFPPKPKDTLMISRTPEVTCVVVDVSHE DPEVKFNWYVDGVEVHNAKTKPREEQYASTYRVVSVLTVLHQDWLNGKE YKCKVSNKALPAPIEKTISKAKGQPREPQVCTLPPSRDELTKNQVSLSC AVKGFYPSDIAVEWESNGQPENNYKTTPPVLDSDGSFFLVSKLTVDKSR WQQGNVFSCSVMHEALHNHYTQKSLSLSPGGSDLLA (1$^{st}$ polypeptide chain- - SEQ ID NO: 272) |
| Cleavage product CP | 263 | AK524 | DKTHTCPPCPAPELLGGPSVFLFPPKPKDTLMISRTPEVTCVVVDVSHE DPEVKFNWYVDGVEVHNAKTKPREEQYASTYRVVSVLTVLHQDWLNGKE YKCKVSNKALPAPIEKTISEAEGQPREPQVYTLPPCRDELTKNQVSLWC LVKGFYPSDIAVEWESEGQPENNYKTTPPVLDSDGSFFLYSKLTVDKSR WQQGNVFSCSVMHEALHNHYTQKSLSLSFGGGSSPPGGGSSGGGSGPAP TSSSTKKTQLQLEHLLLDLQMILNGINNYKNPKLTAMLTAKFAMPKKAT ELKHLQCLEEEALKPLEEVLNLAQSKNFHLRPRDLISNINVIVLELKGSE TTFMCEYADETATIVEFLNRWITFAQSIISTLT (2$^{nd}$ polypeptide chain - SEQ ID NO: 273) |
| | | | DKTHTCPPCPAPELLGGPSVFLFPPKPKDTLMISRTPEVTCVVVDVSHE DPEVKFNWYVDGVEVHNAKTKPREEQYASTYRVVSVLTVLHQDWLNGKE YKCKVSNKALPAPIEKTISKAKGQPREPQVCTLPPSRDELTKNQVSLSC AVKGFYPSDIAVEWESNGGPENNYKTTPPVLDSDGSFFLVSKLTVDKSR WQQGNVFSCSVMHEALHNHYTQKSLSLSPGGSPGDLLA (1$^{st}$ polypeptide chain - SEQ ID NO: 274) |
| Cleavage product CP | 264 | AK525 | DKTHTCPPCPAPELLGGPSVFLFPPKPKDTLMISRTPEVTCVVVDVSHE DPEVKFNWYVDGVEVHNAKTKPREEQYASTYRVVSVLTVLHQDWLNGKE YKCKVSNKALPAPIEKTISKAKGQPREPQVYTLPPCRDELTKNQVSLWC LVKGFYPSDIAVEWESNGQPENNYKTTPPVLDSDGSFFLYSKLTVDKSR WQQGNVFSCSVMHEALHNHYTQKSLSLSPGGGSSPPGGGSSGGGSGPAP TSSSTKKTQLQLEHLLLDLQMILNGINNYKNPKLTAMLTAKFAMPKKAT ELKHLQCLEEEALKPLEEVLNLAQSKNFHLRPRDLISNINVIVLELKGSE TTFMCEYADETATIVEFLNRWITFAQSIISTLT (2$^{nd}$ polypeptide chain - SEQ ID NO: 275) |
| | | | DKTHTCPPCPAPELLGGPSVFLFPPKPKDTLMISRTPEVTCVVVDVSHE DPEVKFNWYVDGVEVHNAKTKPREEQYASTYRVVSVLTVLHQDWLNGKE YKCKVSNKALPAPIEKTISKAKGQPREPQVCTLPPSRDELTKNQVSLSC AVKGFYPSDIAVEWESNGQPENNYKTTPPVLDSDGSFFLVSKLTVDKSR WQQGNVFSCSVMHEALHNHYTQKSLSLSPGGGSPSDLLA (1$^{st}$ polypeptide chain - SEQ ID NO: 276} |

10.1 Other Sequences:

| DESCRIPTION | SEQ ID NO | SEQUENCE |
|---|---|---|
| MM1 | 60 | ELCDDDPPEIPHATFKAMAYKEGTMLNCECKRGFRRIKSGSLYMLCTGNSSHSSWDNQC QCTSSATRNTTKQVTPQPEEQKERKTTEMQSPMQPVDQASLPGHCREPPPWENEATERIY HFVVGQMVYYQCVQGYRALHRGPAESVCKMTHGKTRWTQPQLICT |
| Linker L1 | 61 | PA |
| IL-2 domain | 62 | APTSSSTKKTQLQLEHLLLDLQMILNGINNYKNPKLTRMLTFKFYMPKKATELKHLQCLE EELKPLEEVLNLAQSKNFHLRPRDLISNINVIVLELKGSETTFMCEYADETATIVEFLNRWI TFAQSIISTLT |
| Linker L2 | 63 | GGGGGGGGGGGGGGGGGGGGGGGGGGGGGGGG |
| MM2 | 64 | AVNGTSQFTCFYNSRANISCVWSQDGALQDTSCQVHAWPDRRRWNQTCELLPVSQASW ACNLILGAPDSQKLTTVDIVTLRVLCREGVRWRVMAIQDFKPFENLRLMAPISLQVVHVE THRCNISWEISQASHYFERHLEFEARTLSPGHTWEEAPLLTLKQKQEWICLETLTPDTQYE FQVRVKPLQ |
| HL | 65 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPSRDELTKNQVSLTCLVKGFYPSDIAVEWESNGQPENNYKTTPPVLD SDGSFFLYSKLTVDKSRWQQGNVFSCSVMHEALHNHYTQKSLSLSPG |

| DESCRIPTION | SEQ ID NO | SEQUENCE |
|---|---|---|
| Polypeptide chain | 66 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGPAELCDDDPPEIP<br>HATFKAMAYKEGTMLNCECKRGFRRIKSGSLYMLCTGNSSHSSWDNQCQCTSSATRNTT<br>KQVTPQPEEQKERKTTEMQSPMQPVDQASLPGHCREPPPWENEATERIYHFVVGQMVYY<br>QCVQGYRALHRGPAESVCKMTHGKTRWTQPQLICTGGGGGGGGGGGGGGGGGGGGGGG<br>GGGGGGGGGGGAPTSSSTKKTQLQLEHLLLDLQMILNGINNYKNPKLTRMLTFKFYMPK<br>AKTELKHLQCLEEELKPLEEVLNLAQSKNFHLRPRDLISNINVIVLELKGSETTFMCE<br>YADETATIVEFLNRWITFAQSIISTLTGPPSGSSPMPYDLYHPSGGGAVNGTSQFTCFYN<br>ASRNISCVWSQDGALQDTSCQVHAWPDRRRWNQTCELLPVSQASWACNLILGAPDSQKLT<br>TVDIVTLRVLCREGVRWRVMAIQDFKPFENLRLMAPISLQWHVETHRCNISWEISQASH<br>YFERHLEFEARTLSPGHTWEEAPLLTKQKQEWICLETLTPDTQYEFQVRVKPLQ |
| Polypeptide chain | 67 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEHLLLDLQMILNGINNYKNPKLTRMLTFKFYMPKKATELKHLQCLEEELKPLEEVLNLA<br>QSKNFHLRPRDLISNINVIVLELKGSETTFMCEYADETATIVEFLNRWITFAQSIISTLT |
| Polypeptide chain | 68 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEHLLLDLQMILNGINNYKNPKLTAMLTAKFAMPKKATELKHLQCLEEALKPLEEVLNL<br>AQSKNFHLRPRDLISNINVIVLELKGSETTFMCEYADETATIVEFLNRWITFAQSIISTLT |
| IL-2 domain | 69 | APTSSSTKKTQLQLEHLLLDLQMILNGINNYKNPKLTRMLTFKFYMPKKATELKHLQCLE<br>ERLKPLEEVLNLAQSKNFHLRPRDLISNINVIVLELKGSETTFMCEYADETATIVEFLNRWI<br>TFAQSIISTLT |
| IL-2 domain | 70 | APTSSSTKKTQLQLEHLLLDLQMILNGINNYKNPKLTRMLTEKFYMPKKATELKHLQCLE<br>EELKPLEEVLNLAQSKNFHLRPRDLISNINVIVLELKGSETTFMCEYADETATIVEFLNRWI<br>TFAQSIISTLT |
| IL-2 domain | 71 | APTSSSTKKTQLQLEHLLLDLQMILNGINNYKNPKLTRMLTFKFYMPKKATELKHLQCLE<br>FSLKPLFFVLNLAQSKNFHLRPRDLISNINVIVLFLKGSETTFMCFYADFTATIVFFLNRWI<br>TFAQSIISTLT |
| IL-2 domain | 72 | APTSSSTKKTQLQLEHLLLDLQMILNGINNYKNPKLTRMLTAKFYMPKKATELKHLQCLE<br>EELKPLEEVLNLAQSKNFHLRPRDLISNINVIVLELKGSETTFMCEYADETATIVEFLNRWI<br>TFAQSIISTLT |
| IL-2 domain | 73 | APTSSSTKKTQLQLEHLLLDLQMILNGINNYKNPKLTRMLTFKFRMPKKATELKHLQCLE<br>EELKPLEEVLNLAQSKNFHLRPRDLISNINVIVLELKGSETTFMCEYADETATIVEFLNRWI<br>TFAQSIISTLT |
| IL-2 domain | 74 | APTSSSTKKTQLQLEHLLLDLQMILNGINNYKNPKLTRMLTSKFYMPKKATELKHLQCLE<br>ESLKPLEEVLNLAQSKNFHLRPRDLISNINVIVLELKGSETTFMCEYADETATIVEFLNRWI<br>TFAQSIISTLT |
| Linker L1 | 75 | PGSG |
| Linker L1 | 76 | GGSSPPRAAAVKSPSGP |
| Linker L1 | 77 | GGPGGPRAAAVKSPSGP |
| Linker L1 | 78 | GSPGVPLSLYSGP |
| HL | 79 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVCTLPPSRDELTKNQVSLSCAVKGFYPSDIAVEWESNGQPENNYKTTPPVLD<br>SDGSFFLVSKLTVDKSRWQQGNVFSCSVMHEALHNHYTQKSLSLSPGK |
| HL | 80 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRKELTKNQVSLWCLVKGFYPSDIAVEWESNGQPENNYKTTPPVL<br>KSDGSFFLYSKLTVDKSRWQQGNVFSCSVMHEALHNHYTQKSLSLSPG |
| HL | 81 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVCTLPPSRDELTKNQVSLSCAVKGFYPSDIAVEWESNGQPENNYDTTPPVLD<br>SDGSFFLVSDLTVDKSRWQQGNVFSCSVMHEALHNHYTQKSLSLSPG |

| DESCRIPTION | SEQ ID NO | SEQUENCE |
|---|---|---|
| HL | 82 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRKKLTKNQVSLWCLVKGFYPSDIAVEWESNGQPENNYKTTPPVL<br>DS DGS FFLYSKLTVDKSRWQQGNVFSC SVMHEALHNHYTQKSLSLSPG |
| HL | 83 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVCTLPPSRDELTKNQVSLSCAVEGFYPSDIAVEWESNGQPENNYKTTPPVLD<br>SDGSFFLVSKLTVDKSRWQQGNVFSCSVMHEALHNHYTQESLSLSPG |
| HL | 84 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRKKLTKNQVSLWCLVKGFYPSDIAVEWESNGQPENNYKTTPPVL<br>DSDGSFFLYSKLTVDKSRWQQGNVFSCSVMHEALHNHYTQKSLSLSPGK |
| Polypeptide chain | 85 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGSSPPMPYDL<br>YHPSGPAPTSSSTKKTQLQLEHLLLDLQMILNGINNYKNPKLTRMLTFKFYMPKKATELK<br>HLQCLEEELKPLEEVLNLAQSKNFHLRPRDLISNINVIVLELKGSETTFMCEYADETATIVE<br>FLNRWITFAQSIISTLT |
| Polypeptide chain | 86 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRKELTKNQVSLWCLVKGFYPSDIAVEWESNGQPENNYKTTPPVL<br>KSDGSFFLYSKLTVDKSRWQQGNVFSCSVMHEALHNHYTQKSLSLSPGGPPSGSSPMPY<br>DLYHPSGGGAVNGTSQFTCFYNSRANISCVVVSQDGALQDTSCQVHAWPDRRRWNQTCE<br>LLPVSQASWACNLILGAPDSQKLTTVDIVTLRVLCREGVRWRVMAIQDFKPFENLRLMAP<br>ISLQVVHVETHRCNISWEISQASHYFERHLEFEARTLSPGHTWEEAPLLTLKQKQEWICLE<br>TLTPDTQYEFQVRVKPLQGEFTTWSPWSQPLAFRTKPAALGKD |
| Polypeptide chain | 87 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVCTLPPSRDELTKNQVSLSCAVKGFYPSDIAVEWESNGQPENNYDTTPPVLD<br>SDGSFFLVSDLTVDKSRWQQGNVFSCSVMHEALHNHYTQKSLSLSPGAPTSSSTKKTQLQ<br>LEHLLLDLQMILNGINNYKNPKLTRMLTFKFYMPKKATELKHLQCLEEELKPLEEVLNLA<br>QSKNFHLRPRDLISNINVIVLELKGSETTFMCEYADETATIVEFLNRWITFAQSIISTLT |
| Polypeptide chain | 88 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRKKLTKNQVSLWCLVKGFYPSDIAVEWESNGQPENNYKTTPPVL<br>DSDGSFFLYSKLTVDKSRWQQGNVFSCSVMHEALHNHYTQKSLSLSPGGPPSGSSPMPY<br>DLYHPSGGGAVNGTSQFTCFYNSRANISCVVVSQDGALQDTSCQVHAWPDRRRWNQTCE<br>LLPVSQASWACNLILGAPDSQKLTTVDIVTLRVLCREGVRWRVMAIQDFKPFENLRLMAP<br>ISLQWHVETHRCNISWEISQASHYFERHLEFEARTLSPGHTWEEAPLLTLKQKQEWICLE<br>TLTPDTQYEFQVRVKPLQGEFTTWSPWSQPLAFRTKPAALGKD |
| Polypeptide chain | 89 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVCTLPPSRDELTKNQVSLSCAVEGFYPSDIAVEWESNGQPENNYKTTPPVLD<br>SDGSFFLVSKLTVDKSRWQQGNVFSCSVMHEALHNHYTQESLSLSPGAPTSSSTKKTQLQ<br>LEHLLLDLQMILNGINNYKNPKLTRMLTFKFYMPKKATELKHLQCLEEELKPLEEVLNLA<br>QSKNFHLRPRDLISNINVIVLELKGSETTFMCEYADETATIVEFLNRWITFAQSIISTLT |
| Polypeptide chain | 90 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVCTLPPSRDELTKNQVSLSCAVEGFYPSDIAVEWESNGQPENNYKTTPPVLD<br>SDGSFFLVSKLTVDKSRWQQGNVFSCSVMHEALHNHYTQESLSLSPGGGSSPPMPYDLY<br>HPSGPAPTSSSTKKTQLQLEHLLLDLQMILNGINNYKNPKLTRMLTFKFYMPKKATELKH<br>LQCLEEELKPLEEVLNLAQSKNFHLRPRDLISNINVIVLELKGSETTFMCEYADETATIV<br>EFLNRWITFAQSIISTLT |
| Polypeptide chain | 91 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRKKLTKNQVSLWCLVKGFYPSDIAVEWESNGQPENNYKTTPPVL<br>DSDGSFFLYSKLTVDKSRWQQGNVFSCSVMHEALHNHYTQKSLSLSPGK |
| Polypeptide chain | 92 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRKKLTKNQVSLWCLVKGFYPSDIAVEWESNGQPENNYKTTPPVL<br>DSDGSFFLYSKLTVDKSRWQQGNVFSCSVMHEALHNHYTQKSLSLSPGPGSGAVNGTSQ<br>FTCFYNSRANISCVWSQDGALQDTSCQVHAWPDKRRWNQTCELLPVSQASWACNLILG<br>APDSQKLTTVDIVTLRVLCREGVRWRVMAIQDFKPFENLRLMAPISLQWHVETHRCNIS |

| DESCRIPTION | SEQ ID NO | SEQUENCE |
|---|---|---|
| | | WEISQASHYFERHLEFEARTLSPGHTWEEAPLLTLKQKQEWICLETLTPDTQYEFQVRVK<br>PLQGEFTTWSPWSQPLAFRTKPAALGKD |
| Polypeptide chain | 93 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGSSPPMPYDL<br>YHPSGPAPTSSSTKKTQLQLEHLLLDLQMILNGINNYKNPKLTAMLTAKFAMPKKATELK<br>HLQCLEEALKPLEEVLNLAQSKNFHLRPRDLISNINVIVLELKGSETTFMCEYADETATI<br>VEFLNRWITFAQSIISTLT |
| Polypeptide chain | 94 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGPGGPRAAAV<br>KSPSGPAPTSSSTKKTQLQLEHLLLDLQMILNGINNYKNPKLTRMLTFKFYMPKKATELK<br>HLQCLEEELKPLEEVLNLAQSKNFHLRPRDLISNINVIVLELKGSETTFMCEYADETATIVE<br>FLNRWITFAQSIISTLT |
| Polypeptide chain | 95 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGSSPPRAAAV<br>KSPSGPAPTSSSTKKTQLQLEHLLLDLQMILNGINNYKNPKLTAMLTAKFAMPKKATELK<br>HLQCLEEELKPLEEVLNLAQSKNFHLRPRDLISNINVIVLELKGSETTFMCEYADETATIVE<br>FLNRWITFAQSIISTLT |
| Polypeptide chain | 96 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGPGGPRAAAV<br>KSPSGPAPTSSSTKKTQLQLEHLLLDLQMILNGINNYKNPKLTAMLTAKFAMPKKATELK<br>HLQCLEEELKPLEEVLNLAQSKNFHLRPRDLISNINVIVLELKGSETTFMCEYADETATI<br>VEFLNRWITFAQSIISTLT |
| Polypeptide chain | 97 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGSGRAAAVKS<br>PSGPAPTSSSTKKTQLQLEHLLLDLQMILNGINNYKNPKLTRMLTFKFYMPKKATELKHL<br>QCLEEELKPLEEVLNLAQSKNFHLRPRDLISNINVIVLELKGSETTFMCEYADETATIVE<br>FLNRWITFAQSIISTLT |
| Polypeptide chain | 98 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGSSPPGGGSS<br>GGGSGPAPTSSSTKKTQLQLEHLLLDLQMILNGINNYKNPKLTAMLTAKFAMPKKATEL<br>KHLQCLEEALKPLEEVLNLAQSKNFHLRPRDLISNINVIVLELKGSETTFMCEYADETATI<br>VEFLNRWITFAQSIISTLT |
| Polypeptide chain | 99 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGSSPPMPYDL<br>YHPSGPAPTSSSTKKTQLQLEHLLLDLQMILNGINNYKNPKLTRMLTFKFYMPKKATELK<br>HLQCLEEERLKPLEEVLNLAQSKNFHLRPRDLISNINVIVLELKGSETTFMCEYADETATI<br>VEFLNRWITFAQSIISTLT |
| Polypeptide chain | 100 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGSSPPMPYDL<br>YHPSGPAPTSSSTKKTQLQLEHLLLDLQMILNGINNYKNPKLTRMLTEKFYMPKKATELK<br>HLQCLEEELKPLEEVLNLAQSKNFHLRPRDLISNINVIVLELKGSETTFMCEYADETATI<br>VEFLNRWITFAQSIISTLT |
| Polypeptide chain | 101 | DKTHTCPPCPAPELLGGPSVFLFPPKPKDTLMISRTPEVTCVWDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGSSPPMPYDL<br>YHPSGPAPTSSSTKKTQLQLEHLLLDLQMILNGINNYKNPKLTRMLTFKFYMPKKATELK<br>HLQCLEESLKPLEEVLNLAQSKNFHLRPRDLISNINVIVLELKGSETTFMCEYADETATI<br>VEFLNRWITFAQSIISTLT |

| DESCRIPTION | SEQ ID NO | SEQUENCE |
|---|---|---|
| Polypeptide chain | 102 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGSSPPMPYDL<br>YHPSGPAPTSSSTKKTQLQLEHLLLDLQMILNGINNYKNPKLTRMLTAKFYMPKKATELK<br>HLQCLEEELKPLEEVLNLAQSKNFHLRPRDLISNINIVLELKGSETTFMCEYADETATI<br>VEFLNRWITFAQSIISTLT |
| Polypeptide chain | 103 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGSSPPMPYDL<br>YHPSGPAPTSSSTKKTQLQLEHLLLDLQMILNGINNYKNPKLTRMLTFKFRMPKKATELK<br>HLQCLEEELKPLEEVLNLAQSKNFHLRPRDLISNINIVLELKGSETTFMCEYADETATIVE<br>FLNRWITFAQSIISTLT |
| Polypeptide chain | 104 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGSSPPMPYDL<br>YHPSGPAPTSSSTKKTQLQLEHLLLDLQMILNGINNYKNPKLTRMLTSKFYMPKKATELK<br>HLQCLFFSLKPLFEVLNLAQSKNFHLRPRDLISNINIVLELKGSFTTFMCEYADETATIVE<br>FLNRWITFAQSIISTLT |
| Polypeptide chain | 105 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGSPGVPLSLYSG<br>PAPTSSSTKKTQLQLEHLLLDLQMILNGINNYKNPKLTRMLTFKFYMPKKATELKHLQCL<br>EERLKPLEEVLNLAQSKNFHLRPRDLISNINIVLELKGSETTFMCEYADETATIVEFLNR<br>WITFAQSIISTLT |
| Polypeptide chain | 106 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGSPGVPLSLYSG<br>PAPTSSSTKKTQLQLEHLLLDLQMILNGINNYKNPKLTRMLTEKFYMPKKATELKHLQCL<br>EEELKPLEEVLNLAQSKNFHLRPRDLISNINIVLELKGSETTFMCEYADETATIVEFLNRW<br>ITFAQSIISTLT |
| Polypeptide chain | 107 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGSPGVPLSLYSG<br>PAPTSSSTKKTQLQLEHLLLDLQMILNGINNYKNPKLTRMLTFKFYMPKKATELKHLQCL<br>EESLKPLEEVLNLAQSKNFHLRPRDLISNINIVLELKGSETTFMCEYADETATIVEFLNRW<br>ITFAQSIISTLT |
| Polypeptide chain | 108 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGSPGVPLSLYSG<br>PAPTSSSTKKTQLQLEHLLLDLQMILNGINNYKNPKLTRMLTAKFYMPKKATELKHLQCL<br>EEELKPLEEVLNLAQSKNFHLRPRDLISNINIVLELKGSETTFMCEYADETATIVEFLN<br>RWITFAQSIISTLT |
| Polypeptide chain | 109 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGSPGVPLSLYSG<br>PAPTSSSTKKTQLQLEHLLLDLQMILNGINNYKNPKLTRMLTFKFRMPKKATELKHLQCL<br>EEELKPLEEVLNLAQSKNFHLRPRDLISNINIVLELKGSETTFMCEYADETATIVEFLN<br>RWITFAQSIISTLT |
| Polypeptide chain | 110 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGSPGVPLSLYSG<br>PAPTSSSTKKTQLQLEHLLLDLQMILNGINNYKNPKLTRMLTSKFYMPKKATELKHLQGL<br>EESLKPLEEVLNLAQSKNFHLRPRDLISNINIVLELKGSETTFMCEYADETATFVEFLN<br>RWITFAQSIISTLT |
| Polypeptide chain | 111 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL |

| DESCRIPTION | SEQ ID NO | SEQUENCE |
|---|---|---|
| | | DSDGSFFLYSKLTVDKSRWQQGKVFSCSVMHEALHNHYTQKSLSLSPGGSPGVPLSLYSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT |

10.2 List of Constructs

The table below shows the full sequences for molecules labelled by 'AK' reference number. The component parts of the sequence are also shown as well as the order in which they are assembled in the chains of the molecules. Individual chains are labelled by a 'DNA' reference number:

| Molecule | name | newnames | Component1 Sequence | Component2 Sequence | Component3 Sequence |
|---|---|---|---|---|---|
| AK368 | DNA187 | Hole: hFc(N297A)-hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLVSKLTVDKSRWQQG NVFSCSVMHEALHNHYTQKSLSLSP G (SEQ ID NO: 9) | PGSGS (SEQ ID NO: 14) | AVNGTSQFTCFYNSRANISCVWSQD GALQDTSCQVHAWPDRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTK PAALGKD (SEQ ID NO: 4) |
| AK368 | DNA476 | Knob: hFc(N297A)- [NPMGSC PVNFKLLR WNG]- hIL2(F42S, E82S, C125SA) | DKTHTCPPCPAPELLGGPSVFLFPP KPKDTLMISRTPEVTCVVVDVSHED PEVKFNWYVDGVEVKNAKTKPREEQ YASTYRVVSVLTVLHQDWLNGKEYK CKVSNKALPAPIEKTISKAKGQPRE PQYTLPPCRDELTKNQVSLWCLVK GFYPSDIAVEWESNGQPENNYKTTP PVLDSDGSFFLYSKLTVDKSRWQQG NVFSCSVMHEALHNEYTQKSLSLSP G (SEQ ID NO: 12) | G | NPMGSDPVNFKLLRWNG (SEQ ID NO: 325) |
| AK375 | DNA477 | Knob: mFcIgG2a (LALAPG)- hIL2(R38A, F42A, Y45A, E62A, C125A) | TIKPCPPCKCPAPNAAGGPSVFIFP PKIKDVLMISLSPIVTCVVVDVSSD DPDVQISWFVNNVEVHTAQTQTHRE DYNSTLRVVSALPIQHQDWMSGKEF KCKVNNKDLGAPIERTISKPKGSVR APQVYVLPPCEEEMTKKQVTLWCMV TDFMPEDIYVEWTNNGKTELNYKNT EPVLDSDGSYFMVSKLRVEKKNWVE RNSYSCSVVHEGLHNHHTTKSFSRT PG (SEQ ID NO: 280) | GGSS PPGGG SSGG GSGP (SEQ ID NO: 23) | APTSSSTKKTQLQLEHLLLDLQMIL NGINNYKNPKLTAMLTAKFAMPKKA TELKHLQCLEEALKPLEEVLNLAQS KNFHLRPRDLISNINIVLELKGSE TTFMCEYADETATIVEFLNRWITFA QSISTLT (SEQ ID NO: 3) |
| AK376 | DNA479 | hole: mFcIgG2a (LALAPG) | TIKPCPPCKCPAPNAAGGPSVFIFP PKIKDVLMISLSPIVTCVVVDVSED DPDVQISWFVNNVEVHTAQTQTHRE DYNSTLRVVSALPIQHQDWMSGKEF KCKVNNKDLGAPIERTISKPKGSVR APQVCVLPPPEEEMTKKQVTLSCAV TDFMPEDIYVEWTNNGKTELNYKNT | | |

| | | | | |
|---|---|---|---|---|
| AK376 | DNA478 | Knob: mFcIgG2a (LALAPG)-[VPLSLY]-hIL2(R38A, F42A, Y45A, E62A, C125A) | TIKFCPPCKCPAPNAAGGPSVFIFP PKIKDVLMISLSPIVTCVVVDVSSD DPDVQISWFVNNVEVHTAQTQTHRE DYNSTLRVVSALPIQHQDWMSGKEF KCKVNNKDLGAPIERTISKPKGSVR APQVYVLPPCEEEMTKKQVTLWCMV TDFMPEDIYVEWTNNGKTELNYKNT EPVLDSDGSYFMVSKLRVEKKNWVE RNSYSCSVV

| | | | |
|---|---|---|---|
| AK378 | DNA470 | KCKVNNKDLGAPIERTISKPKGSVR APQVCVLPPPEEEMTKKQVTLSCAV TDFMPEDIYVEWTNNGKTELNYKNT EPVLDSDGSYFMVSKLRVEKKNWVE RNSYSCSVVHEGLHNHHTTKSFSRT PG (SEQ ID NO: 281) | FENLRLMAPISLQVVHVETHRCNIS WEISQASHYFERHLEFEARTLSPGH TWEEAPLLTLKQKQEWICLELTLTPD TQYEFQVRVKPLQGEFTTWSPWSQP LAFRTKPAALGKD (SEQ ID NO: 4) |
| AK378 | Knob: mFcIgG2a (LALAPG)- [VPLSLY]- hIL2(R38A, F42A, Y45A, E62A, C125A) | TIKFCPPCKCPAPNAAGGPSVFIFP PKIKDVLMISLSPIVTCVVVDVSSD DPDVQISWFVNNVEVHTAQTQTHRE DYNSTLRVVSALPIQHQDWMSGKEF KCKVNNKDLGAPIERTISKPKGSVR APQVYVLPPCEEEMTKKQVTLWCMV TDFMPEDIYVEWTNNGKTELNYKNT EPVLDSDGSYFMVSKLRVEKKNWVE RNSYSCSVVHEGLHNHHTTKSFSRT PG (SEQ ID NO: 280) | |
| AK378 | Hole: mFcIgG2a (LALAPG)- hCD122 | TIKFCPPCKCPAPNAAGGPSVFIFP PKIKDVLMISLSPIVTCVVVDVSED DPDVQISWFVNNVEVHTAQTQTHRE DYNSTLRVVSALPIQHQDWMSGKEF KCKVNNKDLGAPIERTISKPKGSVR APQVCVLPPPEEEMTKKQVTLSCAV TDFMPEDIYVEWTNNGKTELNYKNT EPVLDSDGSYFMVSKLRVEKKNWVE RNSYSCSVVHEGLHNHHTTKSFSRT PG (SEQ ID NO: 281) | PGSGS (SEQ ID NO: 14) AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLELTLTPD TQYEFQVRVKPLQGEFTTWSPWSQP LAFRTKPAALGKD (SEQ ID NO: 4) |
| AK397 | DNA158 Hole: hFc(N297A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLVSKLTVDKSRWQQG MVFSCSVMHEALHNHYTQKSLSLSP G (SEQ ID NO: 9) | |

| | | | |
|---|---|---|---|
| AK397 | DNA258 | Hole: hFc(N297A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSGP (SEQ ID NO: 33) | DSGGFMLT (SEQ ID NO: 25) |
| AK429 | DNA477 | Knob: mFcIgG2a (LALAPG)- hIL2(R38A, F42A, Y45A, E62A, C125A) | TIKFCPPCKCPAPNAAGGPSVFIFP PKIKDVLMISLSPIVTCVVVDVSSD DPDVQISWFVNNVEVHTAQTQTHRE DYNSTLRVVSALPIQHQDWMSGKEF KCKVNNKDLGAPIERTISKPKGSVR APQVYVLPPCEEEMTKKQVTLWCMV TDFMPEDIYVEWTNNGKTELNYKNT EPVLDSDGSYFMVSKLRVEKKNWVE RNSYSCSVVHEGLHNHHTTKSFSRT PG (SEQ ID NO: 280) | GGSSP PGGG SSGG GSGP (SEQ ID NO: 23) | APTSSSTKKTQLQLEHLLLDLQMIL NGINNYKNPKLTAMLTAKFAMPKKA TELKHLQCLEEALKPLEEVLNLAQS KNFHLRPRDLISNINVIVLELKGSE TTFMCEYADETATIVEFLNRWITFA QSIISTLT (SEQ ID NO: 3) |
| AK429 | DNA520 | Hole: mFcIgG2a (LALAPG)- NoAnnotation Found | TIKFCPPCKCPAPNAAGGPSVFIFP PKIKDVLMISLSPIVTCVVVDVSED DPDVQISWFVNNVEVHTAQTQTHRE DYNSTLRVVSALPIQHQDWMSGKEF KCKVNNKDLGAPIERTISKPKGSVR APQVCVLPPPEEEMTKKQVTLSCAV TDFMPEDIYVEWTNNGKTELNYKNT EPVLDSDGSYFMVSKLRVEKKNWVE RNSYSCSVVHEGLHNHHTTKSFSRT PG (SEQ ID NO: 281) | HHHH HHHH (SEQ ID NO: 308) | |

| | | -continued | | |
|---|---|---|---|---|
| AK430 | DNA477 | Knob: mPcIgG2a (LALAPG)-hIL2(R38A, F42A, Y45A, E62A, C125A) | TIKFCPPCKCPAPNAAGGPSVFIFP PKIKDVLMISLSPIVTCVVVDVSSD DPDVQISWFVNNVEVHTAQTQTHRE DYNSTLRVVSALPIQHQDWMSGKEF KCKVNNKDLGAPIERTISKPKGSVR APQVYVLPPCEEEMTKKQVTLWCMV TDFMPEDIYVEWTNNGKTELNYKNT EPVLDSDGSYFMVSKLRVEKKNWVE RNSYSCSVVHEGLHNHHTTKSFSRT PG (SEQ ID NO: 280) | GGSSP PGGGS SGG GSGP (SEQ ID NO: 23) | APTSSSTKKTQLQLEHLLLDLQMIL NGINNYKNPKLTAMLTAKFAMPKKA TELKHLQCLEEALKPLEEVLNLAQS KNFHLRPRDLISNINIVLELKGSE TTFMCEYADETATIVEFLNRWITFA QSIISTLT (SEQ ID NO: 3) |
| AK430 | DNA521 | Hole: mPcIgG2a (LALAPG)-hCD122-NoAnnotation Found | TIKFCPPCKCPAPNAAGGPSVFIFP PKIKDVLMISLSPIVTCVVVDVSED DPDVQISWFVNNVEVHTAQTQTHRE DYNSTLRVVSALPIQHQDWMSGKEF KCKVNNKDLGAPIERTISKPKGSVR APQVCVLPPPEEEMTKKQVTLSCAV TDFMPEDIYVEWTNNGKTELNYKNT EPVLDSDGSYFMVSKLRVEKKNWVE RNSYSCSVVHEGLHNHHTTKSFSRT PG (SEQ ID NO: 281) | PGSGS (SEQ ID NO: 14) | AVNGTSQFTCFYNSRANISCVWSQD GALQDTSCQVHAWPDRRRWNQTCEL LFVSQASWACNLILGAPDSQKLITV DIVTLRVLCREGVRWRVMAIQDFKP FENLRLMAPISLQVVHVETHRCNIS WEISQASHYFERHLEPEARTLSPGH TWEEAPLLTLKQKQEWICLETLTPD TQYEFQVRVKPLQGEFTTWSPWSQP LAFRTKPAALGKD (SEQ ID NO: 4) |
| AK431 | | Knob: mPcIgG2a (LALAPG)-hIL2(R38A, F42A, Y45A, E62A, C125A) | TIKFCPPCKCPAPNAAGGPSVFIFP PKIKDVLMISLSPIVTCVVVDVSSD DPDVQISWFVNNVEVHTAQTQTHRE DYNSTLRVVSALPIQHQDWMSGKEF KCKVNNKDLGAPIERTISKPKGSVR APQVYVLPPCEEEMTKKQVTLWCMV TDFMPEDIYVEWTNNGKTELNYKNT EPVLDSDGSYFMVSKLRVEKKNWVE RNSYSCSVVHEGLHNHHTTKSFSRT PG (SEQ ID NO: 280) | GGSSPP GGGSS GG GSGP (SEQ ID NO: 23) | APTSSSTKKTQLQLEHLLLDLQMIL NGINNYKNPKLTAMLTAKFAMPKKA TELKHLQCLEEALKPLEEVLNLAQS KNFHLRPRDLISNINIVLELKGSE TTFMCEYADETATIVEFLNRWITFA QSIISTLT (SEQ ID NO: 3) |

| | | | |
|---|---|---|---|
| AK431 | Hole: mFcIgG2a (LALAPG)-mCD122-NoAnnotationFound | TIKFCPPCKCPAPNAAGGPSVFIFP PKIKDVLMISLSPIVTCVVVDVSED DPDVQISWFVNNVEVHTAQTQTHRE DYNSTLRVVSALPIQHQDWMSGKEF KCKVNNKDLGAPIERTISKPKGSVR APQVCVLPPPEEEMTKKQVTLSCAV TDFMPEDIYVEWTNNGKTELNYKNT EPVLDSDGSYFMVSKLRVEKKNWVE RNSYSCSVVHEGLHNHHTTKSFSRT PG (SEQ ID NO: 281) | PGSGS (SEQ ID NO: 14) | AVKNCSHLECFYNSRANVSCMWSHE EALNVTTCHVHAKSNLRHWNKTCEL TLVRQASWACNLILGSFPESQSLTS VDLLDINVVCWEEKGWRRVKTCDFH PFDNLRLVAPHSLQVLHIDTQRCNI SWKVSQVSHYIEPYLEFEARRLLG HSWEDASVLSLKQRQQMLFLEMLIP STSYEVQVRVKAQRN NTGIWSPWSQPLTFRTRPADPMKE (SEQ ID NO: 326) |
| AK432 | Knob: mFcIgG2a (LALAPG)-[VPLSLY]-hIL2(R38A, F42A, Y45A, E62A, C125A) | TIKFCPPCKCPAPNAAGGPSVFIFP PKIKDVLMISLSPIVTCVVVDVSSD DPDVQISWFVNNVEVHTAQTQTHRE DYNSTLRVVSALPIQHQDWMSGKEF KCKVNNKDLGAPIERTISKPKGSVR APQVYYVLPPCEEEMTKKQVTLWCMV TDFMPEDIYVEWTNNGKTELNYKNT EPVLDSDGSYFMVSKLRVEKKNWVE RNSYSCSVVHEGLHNHHTTKSFSRT PG (SEQ ID NO: 280) | GSPG (SEQ ID NO: 34) | VPLSLY (SEQ ID NO: 28) |
| AK432 | Hole: mFcIgG2a (LALAPG)-hCD122-NoAnnotation Found | TIKFCPPCKCPAPNAAGGPSVFIFP PKIKDVLMISLSPIVTCVVVDVSED DPDVQISWFVNNVEVHTAQTQTHRE DYNSTLRVVSALPIQHQDWMSGKEF KCKVNNKDLGAPIERTISKPKGSVR APQVCVLPPPEEEMTKKQVTLSCAV TDFMPEDIYVEWTNNGKTELNYKNT EPVLDSDGSYFMVSKLRVEKKNWVE RNSYSCSVVHEGLHNHHTTKSFSRT PG (SEQ ID NO: 281) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK433 | Knob: mFcIgG2a (LALAPG)-[VPLSLY]-hIL2(R38A, F42A, Y45A, | TIKFCPPCKCPAPNAAGGPSVFIFP PKIKDVLMISLSPIVTCVVVDVSSD DPDVQISWFVNNVEVHTAQTQTHRE DYNSTLRVVSALPIQHQDWMSGKEF KCKVNNKDLGAPIERTISKPKGSVR APQVYYVLPPCEEEMTKKQVTLWCMV | GSPG (SEQ ID NO: 34) | VPLSLY (SEQ ID NO: 28) |

| | | | |
|---|---|---|---|
| AK433 | E62A, C125A | TDFMPEDIYVEWTNNGKTELNYKNT EPVLDSDGSYFMVSKLRVEKKNWVE RNSYSCSVHEGLHNHHTTKSFSRT PG (SEQ ID NO: 280) | |
| AK435 | Hole: mFcIgG2a (LALAPG)- hCD122- NoAnnotation Found | TIKPCPPCKCPAPNAAGPSVFIFP PKIKDVLMISLSPIVTCVVVDVSED DPDVQISWFVNNVEVHTAQTQTHRE DYNSTLRVVSALPIQHQDMSGKEF KCKVNNKDLGAPIERTISKPKGSVR APQVCVLPPPEEEMTKKQVTLSCAV TDFMPEDIYVEWTNNGKTELNYKNT EPVLDSDGSYFMVSKLRVEKKNWVE RNSYSCSVHEGLHN HHTTKSFSRTPG (SEQ ID NO: 281) | PGSGS (SEQ ID NO: 14) | AVKNCSHLECFYNSRANVSCMWSHE EALNVTTCHVHAKSNLRHWNKTCEL TLVRQASWACNLILGSFPESQSLTS VDLLDINVVCWEEKGWRRVKTCDFH PFDNLRLVAPHSLQVLHIDTQRCNI SWKVSQVSHYIEPYLEFEARRLLG HSWEDASVLSLKQRQQWLFLEMLIP STSYEVQVRVKAQRNNTGTWSPWSQ PLTFRTRPADPMKE (SEQ ID NO: 326) |
| AK435 | Knob: hFc(N297A)- [VPLSLY]- hIL2(R38A, F42A, Y45A, E62A, C125A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSPG (SEQ ID NO: 34) | VPLSLY (SEQ ID NO: 28) |
| AK435 | F8scFvVersion1- Hole: hFc(N297A)- hCD122- NoAnnotation Found | EVQLLESGGGLVQPGGSLRLSCAASG FTFSLFTMSWVRQAPGKGLEVVVSA ISGSGGSTYYADSVKGRFTISRDNS KNTLYLQMNSLRAEDTAVYYCAKST HLYLFDYWGQGTLVTVSSGGGGSGG GGSGGGGSEIVLTQSPGTLSLSPGE RATLSCRASQSVSMPFLAWYQQKPG QAPRLLIYGASSRATGIPDRFSGSG SGTDFTLTISRLEPEDFAVYYCQQM RGRPPTFGQGTKVEIK (SEQ ID NO: 282) | GGS | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLYSKLTVDKSRWQQG NVFSCSVMHEALHNH YTQKSLSLSPG (SEQ ID NO: 9) |

| AK436 | DNA187 | Hole: hFc(N297A)-hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLYSKLTVDKSRWQQG NVFSCSVMHEALHNHYTQKSLSLSP G (SEQ ID NO: 9) | PGSGS (SEQ ID NO: 14) | AVNGTSQFTCFYNSRANISCVWSQD GALQDTSCQVHA WPDRRRMNQTCELLFVSQASWACNL ILGAPDSQKLTT VDIVTLRVLCREGVRWRVMAIQDFK PFENLRLMAPIS LQVVHVETHRCNISWEISQASHYFE RHLEFEARTLSP GHTWEEAPLLTLKQKQEWICLETLT PDTQYEFQVRVK PLQGEFTTWSPWSQPLAFRTKPAAL GKD (SEQ ID NO: 4) |
| AK436 | DNA542 | Knob: hFc(N297A)-[VPLSLY]-hIL2 (R38A, F42A, Y45A, E62A, C125A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | | APTSSSTKKTQLQLEHLLLDLQMIL NGINNYKNPKLTAMLTAKFAMPKKA TELKHLQCLEEALKPLEEVLNLAQS KNFHLRPRDLISNINIVLELKGSE TTFMCEYADETATIVEFLNRWITFA QSIISTLT (SEQ ID NO: 3) |
| AK437 | DNA187 | Hole: hFc(N297A)-hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLVSKLTVDKSRWQQG MVFSCSVMHEALHNHYTQKSLSLSP G (SEQ ID NO: 9) | PGSGS (SEQ ID NO: 14) | AVNGTSQFTCFYNSRANISCVWSQD GALQDTSCQVHAWPDRRRWMNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |

| | | | |
|---|---|---|---|
| AK437 | DNA545 | Knob: hFc(N297A)-[VPLSLY]-hIL2(R38A, F42A, Y45A, E62A, C125A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GISSGLL SGRSSGP (SEQ ID NO: 311) | APTSSSTKKTQLQLEHLLLDLQMIL NGINNYKNPKLTAMLTAKFAMPKKA TELKHLQCLEEALKPLEEVLNLAQS KNFHLRPRDLISNINVIVLELKGSE TTFMCEYADETATIVEFLNRWITFA QSIISTLT (SEQ ID NO: 3) |
| AK438 | DNA255 | Knob: hFc(N297A)-hIL2(R38A, F42A, Y45A, E62A, C125A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GGSS PPGG GSSGG GSGP (SEQ ID NO: 23) | APTSSSTKKTQLQLEHLLLDLQMIL NGINNYKNPKLTAMLTAKFAMPKKA TELKHLQCLEEALKPLEEVLNLAQS KNFHLRPRDLISNINVIVLELKGSE TTFMCEYADETATIVEFLNRWITFA QSIISTLT (SEQ ID NO: 3) |
| AK438 | DNA543 | Hole: hFc(N297A)-hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLYSKLTVDKSRWQQG MVFSCSVMHEALHNHYTQKSLSLSP G (SEQ ID NO: 9) | GPPSGSSPG (SEQ ID NO: 36) | VPLSLY (SEQ ID NO: 28) |
| AK439 | DNA158 | Hole: hFc(N297A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE | | |

-continued

| | | | |
|---|---|---|---|
| AK439 | | PQVCTLPPSRDELTKNQVSLSCAVK GFYPSDIAVEWESNGQPENNYKTTP PVLDSDGSFFLVSKLTVDKSRWQQG MVFSCSVMHEALHNHYTQKSLSLSP G (SEQ ID NO: 9) | |
| | DNA544 | Knob: hFc(N297A)- [VPLSLY]- hIL2 (R38A, F42A, Y45A, E62A, L80F, R8D, L85V, I86V, I92F, C125A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSPG (SEQ ID NO: 34) | VPLSLY (SEQ ID NO: 28) |
| AK440 | DNA187 | Hole: hFc(N297A)- hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLVSKLTVDKSRWQQG MVFSCSVMHEALHNHYTQKSLSLSP G (SEQ ID NO: 9) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK440 | DNA544 | Knob: hFc(N297A)- [VPLSLY]- hIL2 (R38A, F42A, Y45A, E62A, L80F, R8D, L85V, I86V, I92F, C125A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSPG (SEQ ID NO: 34) | VPLSLY (SEQ ID NO: 28) |
| AK441 | DNA543 | Hole: hFc(N297A)- | DKTHTCPPCPAPELLGGPSVFLFPP KPKDTLMISRTPEVTCVVVDSHED | GPPSG SSPG | VPLSLY (SEQ ID |

-continued

| | | | | |
|---|---|---|---|---|
| | [VPLSLY]-hCD122 | PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLVSKLTVDKSRWQQG MVFSCSVMHEALHNHYTQKSLSLSP G (SEQ ID NO: 9) | | (SEQ ID NO: 28) |
| AK441 DNA546 | Knob: hFc(N297A)-hIL2 (R38A, F42A, Y45A, E62A, L80F, R83D, L85V, I86V, I92F, C125A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHE ALNHHYTQKSLSLSPG (SEQ ID NO: 12) | GGSSP PGGG SSGG GSGP (SEQ ID NO: 23) | APTSSSTKKTQLQLEHLLLDLQMIL NGINNYKNPKLTAMLTAKFAMPKKA TELKHLQCLEEALKPLEEVLNLAQS KNFHFDPRDWSNINVFVLELKGSET TFMCEYADETATIVEFLNRWITFAQ SIISTLT (SEQ ID NO: 328) |
| AK442 DNA255 | Knob: hFc(N297A)-hIL2(R38A, F42A, Y45A, E62A, C125A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GGSSPP GGGSS GG GSGP (SEQ ID NO: 23) | APTSSSTKKTQLQLEHLLLDLQMIL NGINNYKNPKLTAMLTAKFAMPKKA TELKHLQCLEEALKPLEEVLNLAQS KNFHLRPRDLISNINVIVLELKGSE TTFMCEYADETATIVEFLNRWITFA QSIISTLT (SEQ ID NO: 3) |
| AK442 DNA553 | Hole: hFc(N297A)-[DSGGFMLT]-hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLVSKLTVDKSRWQQG MVFSCSVMHEALHNHYTQKSLSLSP G (SEQ ID NO: 9) | GPPS GSSPG (SEQ ID NO: 36) | DSGGFMLT (SEQ ID NO: 25) |

| | | | | |
|---|---|---|---|---|
| AK443 | DNA187 | Hole: hFc(N297A)-hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLYSKLTVDKSRWQQG MVFSCSVMHEALHNHYTQKSLSLSP G (SEQ ID NO: 9) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHETHRCNIS WEISQASHYFERHLEFEARTLSPGH TWEEAPLLTLKQKQEWICLETLTPD TQYEFQVRVKPLQGEFTTWSWSQP LAFRTKPAALGKD (SEQ ID NO: 4) |
| AK443 | DNA554 | Knob: hFc(N297A)-[VPLSLY]-hIL2(E15R, L18C, D20R, R38A, F42A, Y45A, E62A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSPG (SEQ ID NO: 34) | VPLSLY (SEQ ID NO: 28) |
| AK444 | DNA281 | Knob: hFc(N297A)-[VPLSLY]-hIL2(R38A, F42A, Y45A, E62A, C125A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSGP (SEQ ID NO: 33) | DSGGFMLT (SEQ ID NO: 25) |
| AK444 | DNA440 | Hole: hFc(N297A)-hCD122 (C122S, C168S) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPSRDELTKNQVSLSCAVK | PGSGS (SEQ ID NO: 14) | AVNGTSQFTCFYNSRANISCVWSQD GALQDTSCQVHAWPDRRRWNQTCEL LPVSQASWACNLILGAPDSQKLTTV DIVTLRVLCREGVRWRVMAIQPFKP FENLRLMAPISLQVVHETHRSNIS WEISQASHYFERHLEFEARTLSPGH |

| | | | |
|---|---|---|---|
| AK449 | DNA547 | Hole: hFcIgG1 (N297A + EPKSS) - hFc (N297A) - hCD122 | GFYPSDIAVEWESNGQPENNYKTTP PVLDSDGSFFLVSKLTVDKSRWQQG MVFSCSVMHEALHNHYTQKSLSLSP G (SEQ ID NO: 9) | TWEEAPLLTLKQKQEWISLETLTPD TQYEFQVRVKPLQGEFTTWSPWSQP LAFRTKPAALGKD (SEQ ID NO: 5) |
| AK449 | DNA550 | Hole: hFcIgG1 (N297A + EPKSS) - hFc (N297A) - hCD122 | EPKSSDKTHTCPPCPAPELLGGPSV FLFPPKPKDTLMISRTPEVTCVVVD VSHEDPEVKFNWYVDGVEVHNAKTK PREEQYASTYRVVSVLTVLHQDWLN GKEYKCKVSNKALPAPIEKTISKAK GQPREPQVCTLPPSRDELTKNQVSL SCAVKGFYPSDIAVEWESNGQPENN YKTTPPVLDSDGSFFLVSKLTVDKS RWQQGNVFSCSVMHEALHNHYTQKS LSLSPG (SEQ ID NO: 285) | AVNGTSQFTCFYNSRANISCVWSQD GALQDTSCQVHAWPDRRRWMNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK449 | DNA550 | Knob: hFcIgG1 (N297A + EPKSS) - hIL2 (R38A, F42A, Y45A, E62A, C125A) | EPKSSDKTHTCPPCPAPELLGGPSV FLFPPKPKDTLMISRTPEVTCVVVD VSHEDPEVKFNWYVDGVEVHNAKTK PREEQYASTYRVVSVLTVLHQDWLN GKEYKCKVSNKALPAPIEKTISKAK GQPREPQVYTLPPCRDELTKNQVSL WCLVKGFYPSDIAVEWESNGQPENN NYKTTPPVLDSDGSFFLYSKLTVDK SRWQQGNVFSCSVMHEALHNHYTQK SLSLSPG (SEQ ID NO: 288) | PGSGS (SEQ ID NO: 14) VPLSLY (SEQ ID NO: 28) |
| AK450 | DNA548 | Hole: hFcIgG1 (N297A + AKT) - hFc (N297A) - hCD122 | AKTDKTHTCPPCPAPELLGGPSVFL FPPKPKDTLMISRTPEVTCVVVDVS HEDPEVKFNWYVDGVEVHNAKTKPR EEQYASTYRVVSVLTVLHQPWLNGK EYKCKVSNKALPAPIEKTISKAKGQ PREPQVCTLPPSRDELTKP NQVSLSCAVKGFYPSDIAVEWESNG QPENNYKTTPPVLDSDGSFFLYSKL TVDKSRWQGGNVFSCSVMHEALHNH YTQKSLSLSPG (SEQ ID NO: 286) | AVNGTSQFTCFYNSRANISCVWSQD GALQDTSCQVHAWPDRRRWMNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK450 | DNA551 | Knob: hFcIgG1 (N297A + AKT) - | AKTDKTHTCPPCPAPELLGGPSVFL FPPKPKDTLMISRTPEVTCVVVDVS HEDPEVKFNWYVDGVEVHNAKTKPR | PGSGG (SEQ ID NO: 14) VPLSLY (SEQ ID NO: 28) |

| | | | | |
|---|---|---|---|---|
| AK451 | [VPLSLY]-hIL2(R38A, F42A, Y45A, E62A, C125A) | EEQYASTYRVVSVLTVLHQDWLNGK EYCKKVSNKALPAPIEKTISKAKGQ PREPQVTLPPCRDELTKNQVSLMC LVKGFYPSDIAVEWESNGQPENNYK TTPPVLDSDGSFFLYSKLTVDKSRW QQGNVFSCSVMHEALHNHYTQKSLS LSPG (SEQ ID NO: 289) | | |
| DNA549 | Hole: hFcIgG1 (N297A AKTEPKSS)-hCD122 | AKTEPKSSDKTHTCPPCPAPELLGG PSVFLFPPKPKDVLMISRTPEVTCV VVDVSHEDPEVKFNWYVDGVEVHNA CTKPREEQYASTYRVVSVLTVLHQD WLNGKEYKCKVSNKALPAPIEICTI SKAKGQPREPQVCTLPPSRDELTKN QVSLSCAVKGFYPSDIAVEWESNGQ PENNYKTTPPVLDSDG SFFLYSKLTVDKSRWQQGNVFSCSV MHEALHNHYTQKSLSLSPG (SEQ ID NO: 287) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLLTLKQKQEWICLETLTPD TQYEFQVRVKPLQGEFTTWSPWSQP LAFRTKPAALGKD (SEQ ID NO: 4) |
| AK451 | Knob: hFcIgG1 (N297A AKTAKTEPKSS)-[VPLSLY]-hIL2(R38A, F42A, Y45A, E62A, C125A) | AKTEPKSSDKTFITCPPCPAPELLG GPSVFLFPPKPKDTLMISRTPEVTC VVVDVSHEDPEVKENWYVDGVEVHN AKTKPREEQYASTYRWSVLTVLHQD WLNGKEYKCKVSNKALPAPIEKTI SKAKGQPREPQVTLPPCRDELTKN QVSLWCLVKGFYPSDIAVEWESNGQ PENNYKTTPPVLDSDGSFFLYSKLT VDKSRWQQGNVFSCSVMHEALHNHY TQKSLSLSPG (SEQ ID NO: 290) | GSPG (SEQ ID NO: 34) | VPLSLY (SEQ ID NO: 28) |
| AK452 | Hole: hFc(N297A)-hCD122 | DKTHTCPPCPAPELLGGPSVFLFPP KPKDTLMISRTPEVTCVVVDVSHED PEVKFNWVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLYSKLTVDKSRWQQG MVFSCSVMHEALHNHYTQKSLSLSP G (SEQ ID NO: 9) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |

-continued

| | | | | |
|---|---|---|---|---|
| AK452 | DNA563 | Knob: hFc(N297A)-[VPLSLY]-hIL2(E15R, L18C, D20R, R38A, F42A, Y45A, E62A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSPG (SEQ ID NO: 34) | VPLSLY (SEQ ID NO: 28) |
| AK453 | DNA187 | Hole: hFc(N297A)-hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLVSKLTVDKSRWQQG MVFSCSVMHEALHNHYTQKSLSLSP G (SEQ ID NO: 9) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK453 | DNA565 | Knob: hFc(N297A)-[VPLSLY]-hIL2(E15L, L18C, D20R, R38A, F42A, Y45A, E62A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSPG (SEQ ID NO: 34) | VPLSLY (SEQ ID NO: 28) |
| AK454 | DNA187 | Hole: hFc(N297A)-hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH |

| | | -continued | |
|---|---|---|---|
| AK454 | DNA566 | Knob: hFc(N297A)-[VPLSLY]-hIL2(E15R, L18C, D20R, R38A, F42A, Y45A, E62A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSPG (SEQ ID NO: 34) | VPLSLY (SEQ ID NO: 28) |
| AK455 | DNA187 | Hole: hFc(N297A)-hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPSRDELTKNQVSLSCAVK GFYPSDIAVEWESNGQPENNYKTTP PVLDSDGSFFLVSKLTVDKSRWQQG MVFSCSVMHEALHNHYTQKSLSLSP G (SEQ ID NO: 9) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK455 | DNA567 | Knob: hFc(N297A)-[VPLSLY]-hIL2(L18C, D20R, R38A, F42A, Y45A, E62A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSPG (SEQ ID NO: 34) | VPLSLY (SEQ ID NO: 28) |
| AK456 | DNA187 | Hole: hFc(N297A)-hCD122 | DKTHTCPPCPAPELLGGPSVFLFPP KPKDTLMISRTPEVTCVVVDVSHED PEVKFNWYVDGVEVHNAKTKPREEQ | PGSGS (SEQ ID NO: 14) | AVNGTSQFTCFYNSRANISCVWSQD GALQDTSCQVHAWPDRRRWNQTCEL LFVSQASWACNLILGAPDSQKLTTV |

| | | | |
|---|---|---|---|
| AK456 | DNA568 | Knob: hFc(N297A)-[VPLSLY]-hIL2(DAPG)(E15F, L18C, D20R, R38A, F42A, Y45A, E62A) | YASTYRVVSLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLVSKLTVDKSRWQQG MVFSCSVMHEALHNHYTQKSLSLSP G (SEQ ID NO: 9) | DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| | | | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | VPLSLY (SEQ ID NO: 34) |
| AK462 | DNA530 | Knob: mFcIgG1(DAPG)-hIL2(R38A, F42A, Y45A, E62A) | VRSGCKPCICTVPEVSSVFIFPPKP KDVLTITLTPKVTCVVVAISKDDPE VQFSWFVDDVEVHTAQTQPREEQFN STPRSVSELPIMHQDWLKGKEFKCR VNSAAFGAPIEKTISKTKGRPKAPQ VYTIPPPKEQMAKDKVSLTCMITDF FPEDITVEWQWNGQPAENYDNTQPI MDTDGSYFVYSKLNVQKSNWEAGNT FTCSVLHEGLHNHHTEKSLSHSPG (SEQ ID NO: 283) | APTSSSTKKTQLQLEHLLLDLQMIL NGINNYKNPKLTAMLTAKFAMPKKA TELKHLQCLEEALKPLEEVLNLAQS KNFHLRPRDLISNINIVLELKGSE TTFMCEYADETATIVEFLNRWITFA QSIISTLT (SEQ ID NO: 3) |
| AK462 | DNA532 | Hole: mFcIgG1(DAPG) | VRSGCKPCICTVPEVSSVFIFPPKP KDVLTITLTPKVTCVVVAISKDDPE VQFSWFVDDVEVHTAQTQPREEQFN STPRSVSELPIMHQDWLKGKEFKCR VNSAAFGAPIEKTISKTKGRPKAPQ VYTIPPPKKQMAKDKVSLTCMITDF FPEDITVEWQWNGQPAENYKNTQPI MKTDGSYFVYSKLNVQKSNWEAGNT FTCSVLHEGLHNHHTEKSLSHSPG (SEQ ID NO: 284) | GSSPPG GGSSGG |
| AK463 | DNA530 | Knob: mFcIgG1 | VRSGCKPCICTVPEVSSVFIFPPKP KDVLTITLTPKVTCVVVAISKDDPE | APTSSSTKKTQLQLEHLLLDLQMIL NGINNYKNPKLTAMLTAKFAMPKKA |

| | | | |
|---|---|---|---|
| AK463 | (DAPG)-hIL2(R38A, F42A, Y45A, E62A) | VQPSWFVDDVEVHTAQTQPREEQFN STFRSVSELPIMHQDWLKGKEFKCR VNSAAFGAPIEKTISKTKGRPKAPQ VYTIPPKEQMAKDKVSLTCMITDF FPEDITVEWQWNGQPAENYDNTQPI MDTDGSYFVYSDLNVQKSNWEAGNT FTCSVLHEGLHNHHTEKSLSHSPG (SEQ ID NO: 283) | GSGP (SEQ ID NO: 23) | TELKHLQCLEEALKPLEEVLNLAQS KNFHLRPRDLISNINIVLELKGSE TTFMCEYADETATIVEFLNRWITFA QSIISTLT (SEQ ID NO: 3) |
| AK464 | DNA533 Hole: mFcIgG1 (DAPG)-hCD122 | VRSGCKPCICTVPEVSSVFIFPPKP KDVLTITLTPKVTCVVVAISKDDPE VQPSWFVDDVEVHTAQTQPREEQFN STFRSVSELPIMHQDWLKGKEFKCR VNSAAFGAPIEKTISKTKGRPKAPQ VYTIPPKKQMAKDKVSLTCMITDF FPEDITVEWQWNGQPAENYKNTQPI MKTDGSYFVYSKLNVQKSNWEAGNT FTCSVLHEGLHNHHTEKSLSHSPG (SEQ ID NO: 284) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK464 | DNA530 Knob: mFcIgG1 (DAPG)-hIL2(R38A, F42A, Y45A, E62A) | VRSGCKPCICTVPEVSSVFIFPPKP KDVLTITLTPKVTCVVVAISKDDPE VQPSWFVDDVEVHTAQTQPREEQFN STFRSVSELPIMHQDWLKGKEFKCR VNSAAFGAPIEKTISKTKGRPKAPQ VYTIPPKKQMAKDKVSLTCMITDF FPEDITVEWQWNGQPAENYKNTQPI MKTDGSYFVYSKLNVQKSNWEAGNT FTCSVLHEGLHNHHTEKSLSHSPG (SEQ ID NO: 283) | GSSPPG GGSSGG GSGP (SEQ ID NO: 23) | APTSSSTKKTQLQLEHLLLDLQMIL NGINNYKNPKLTAMLTAKFAMPKKA TELKHLQCLEEALKPLEEVLNLAQS KNFHLRPRDLISNINIVLELKGSE TTFMCEYADETATIVEFLNRWITFA QSIISTLT (SEQ ID NO: 3) |
| AK464 | DNA534 Hole: mFcIgG1 (DAPG)-hCD122 | VRSGCKPCICTVPEVSSVFIFPPKP KDVLTITLTPKVTCVVVAISKDDPE VQPSWFVDDVEVHTAQTQPREEQFN STFRSVSELPIMHQDWLKGKEFKCR VNSAAFGAPIEKTISKTKGRPKAPQ VYTIPPKKQMAKDKVSLTCMITDF FPEDITVEWQWNGQPAENYKNTQPI MKTDGSYFVYSKLNVQKSNWEAGNT FTCSVLHEGLHNHHTEKSLSHSPG (SEQ ID NO: 284) | PGSGS (SEQ ID NO: 14) | AVKNCCSHLECFYNSRANVSCMWSHE EALNVTTCHVHAKSNLRHWNKTCEL TLIVRQASWACNLILGSFPESQSLTS VDLLDINVVCWEEKGWRRVKTCDFH PFDNLRIVAPHSLQVLHIDTQRCNI SWKVSQVSHYIEPYLEFEARRLLG HSWEDASVLSLKQRQQWLFLEMLIP STSYEVQVRVKAORNN TGTWSPWSQPLTFRTRPADPVIKF (SEQ ID NO: 326) |
| AK465 | DNA531 Knob: mFcIgG1 (DAPG)- | VRSGCKPCICTVPEVSSVFIFPPKP KDVLTITLTPKVTCVVVAISKDDPE VQPSWFVDDVEVHTAQTQPREEQFN | GSPG (SEQ ID NO: 34) | VPLSY (SEQ ID NO: 28) |

| | | | | |
|---|---|---|---|---|
| AK466 | DNA5332 | [VPLSLY]-hIL2(R38A, F42A, Y45A, E62A) | STFRSVSELPIMHQDWLKGKEFKCR VNSAAFGAPIEKTISKTKGRPKAPQ VYTIPPPKEQMAKDKVSLTCMITDF FPEDITVEWQWNGQPAENYDNTQPI MDTDGSYFVYSDLNVQKSNWEAGNT FTCSVLHEGLHNHHTEKSLSHSP

| | | | |
|---|---|---|---|
| AK467 | C325A) | VNSAAFGAPIEKTISKTKGRPKAPQ VYTIPPPKEQMAKDKVSLTCMITDF FPEDITVEWQWNGQPAENYDNTQPI MDTDGSYFVYSDLNVQKSNWEAGNT FTCSVLHEGLHNHHTEKSLSHSPG (SEQ ID NO: 283) | |
| AKA68 | DNA534 Hole: mFcIgG1 (DAPG)-hCD122 | VRSGCKPCICTVPEVSSVFIFPPKP KDVLTITLTPKVTCVVVAISKDDPE VQFSWFVDDVEVHTAQTQPREEQFN STFRSVSELPIMHQDWLKGKEFKCR VNSAAFGAPIEKTISKTKGRPKAPQ VYTIPPPKKQMAKDKVSLTCMITDF FPEDITVEWQWNGQPAENYKNTQPI MKTDGSYFVYSKLNVQKSNWEAGNT FTCSVLHEGLHNHHTEKSLSHSPG (SEQ ID NO: 284) | PGSGS (SEQ ID NO: 14) | AVKNCSHLECFYNSRANVSCMWSHE EALNVTTCHVHAKSNLRHWNKTCEL TLVRQASWACNLILGSFPESQSLTS VDLLDINVCWEEKGWRRVKTCDFH PFDNLRLVAPHSLQVLIHIDTQRCNI SWKVSQVSHYIEPYLEFEARRLLG HSWEDASVLSLKQRQQWLFLEMLIP STSYEVQVRVKAORNN TGTWSPWSQPLTFRTRPADPVIKF (SEQ ID NO: 326) |
| AKA68 | DNA576 Hole: hFc(N237A, M252Y, S254T, T256E)-hCD122 | DKTHTCPPCPAPELLGGPSVFLFPP KPKDTLYITREPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDG SPPLVSKLTVDKSRWQQGMVFSCSV MHEALHNHYTQKSLSLSPG (SEQ ID NO: 292) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK468 | DNA580 Knob: hFc(M297A, M252Y, S254T, T256E)-[VPLSLY]- hIL2, R38A, F42A, Y45A, E52A, C125A) | DKTHTCPPCPAPELLGGPSVFLFPP KPKDTLYITREPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVPSCSVMHEALHNHYTQKSLSLSP G (SEQ ID NO: 294) | GSPG (SEQ ID NO: 34) | VPLSY (SEQ ID NO: 28) |
| AK469 | DNA575 Hole: hFc(N297A, I253A)- | DKTHTCPPCPAPELLGGPSVFLFPP KPKDTLMASRTPEVTCVVVDVSHED PEVKFNWYVDGVEVHNAKTKPREEQ | PGSGS (SEQ ID NO: 14) | AVNGTSQFTCFYNSRANISCVWSQD GALQDTSCQVHAWPDRRRWNQTCEL LFVSQASWACNLILGAPDSQKLTTV |

| | | | |
|---|---|---|---|
| AK469 | hCD122 | | YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLYSKLTVDKSRWQQG NVFSCSVMHEALHNHYTQKSLSLSP G (SEQ ID NO: 10) | DIVTLRVLCREGVRWRVMAIQDFKP FENLRLMAPISLQVVHVETHRCNIS WEISQASHYFERHLEFEARTLSPGH TWEEAPLLTLKQEWICLETLTPD TQYEFQVRKPLQGEFTTWSPWSQP LAFRTKPAALGKD (SEQ ID NO: 4) |
| DNA577 | Knob: hFc(N297, I253A)- hIL2 (R38A, F42A, Y45A, E52A, C125A) | DKTHTCPPCPAPELLGGPSVFLFPP KPKDTLMASRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 13) | GSSPPG GGSSGG GSGP (SEQ ID NO: 23) | APTSSSTKKTQLQLEHLLLDLQMIL NGINNYKNPKLTAMLTAKFAMPKKA TELKHLQCLEEALKPLEEVLNLAQS KNFHLRPRDLISNINIVLELKGSE TTFMCEYADETATIVEFLNRWITFA QSIISTLT (SEQ ID NO: 3) |
| AK470 | Hole: hFc(N297A, M252Y, S254T, T256E)- hCD122 | DKTHTCPPCPAPELLGGPSVFLFPP KPKDTLYITREPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDG SPFLVSKLTVDKSRWQGQMVFSCSV MHEALHNHYTQKSLSLSPG (SEQ ID NO: 292) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQEWICLETLTPD TQYEFQVRKPLQGEFTTWSPWSQP LAFRTKPAALGKD (SEQ ID NO: 4) |
| DNA578 | Knob: hFc(N297A, M252Y, S254T, T256E)- hIL2(R38A, F42A, Y45A, E62A, C125A) | DKTHTCPPCPAPELLGGPSVFLFPP KPKDTLYITREPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 294) | GSSPPGGGSSGG GSGP (SEQ ID NO: 23) | APTSSSTKKTQLQLEHLLLDLQMIL NGINNYKNPKLTAMLTAKFAMPKKA TELKHLQCLEEALKPLEEVLNLAQS KNFHLRPRDLISNINIVLELKGSE TTFMCEYADETATIVEFLNRWITFA QSIISTLT (SEQ ID NO: 3) |

| | | | | |
|---|---|---|---|---|
| AK471 | DNA575 | Hole: hFc(N297A, I253A)-HCD122 | DKTHTCPPCPAPELLGGPSVFLFPP KPKDTLMASRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLYSKLTVDKSRWQQG NVFSCSVMHEALHNHYTQKSLSLSP G (SEQ ID NO: 10) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK471 | DNA579 | Knob: hFc(M297, I253A)-[VPLSLY]-hIL2(R38A, F42A, Y45A, E62A, C125A) | DKTHTCPPCPAPELLGGPSVFLFPP KPKDTLMASRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCIVK GFYPSDIAVEWESNGQPENNYKTTP PVLDSDGSFFLYSKLTVDKSRWQQG NVFSCSVMHEALHNHYTQKSLSLSP G (SEQ ID NO: 13) | GSPG (SEQ ID NO: 34) | VPLSLY (SEQ ID NO: 28) |
| AK439 | DNA158 | Hole: hFc(N297A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLVSKLTVDKSRWQQG MVFSCSVMHEALHNHYTQKSLSLSP G (SEQ ID NO: 9) | | |
| AK439 | DNA544 | Knob: hFc(N297A)-[VPLSLY]-hIL2 (R38A, F42A, Y45A, E62A, | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCIVK | GSPG (SEQ ID NO: 34) | VPLSLY (SEQ ID NO: 28) |

-continued

| | | | |
|---|---|---|---|
| AK440 | DNA187 | L80F, R53D, L85V, I86V, I92F, C125A) | GFYPSDIAVEWESNGQPENNYKTTP PVLDSDGSFFLYSKLTVDKSRWQQG NVFSCSVMHEALHNHYTQKSLSLSP G (SEQ ID NO: 12) | |
| AK440 | DNA187 | Hole: hFc(N297A)- hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLVSKLTVDKSRWQQG MVFSCSVMHEALHNHYTQKSLSLSP G (SEQ ID NO: 9) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK441 | DNA544 | Knob: hFc(N297A)- [VPLSLY]- hIL2 (R38A, F42A, Y45A, E62A, L80F, R53D, L85V, I86V, I92F, C125A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPSRDELTKNQVSLWCLVK GFYPSDIAVEWESNGQPENNYKTTP PVLDSDGSFFLVSKLTVDKSRWQQG NVFSCSVMHEALHNHYTQKSLSLSP G (SEQ ID NO: 12) | GSPG (SEQ ID NO: 34) | VPLSLY (SEQ ID NO: 28) |
| AK441 | DNA543 | Hole: hFc(N297A)- [VPLSLY]- hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLVSKLTVDKSRWQQG MVFSCSVMHEALHNHYTQKSLSLSP G (SEQ ID NO: 9) | GPPSGSSPG (SEQ ID NO: 36) | VPLSLY (SEQ ID NO: 28) |
| AK441 | DNA546 | Knob: hFc(N297A)- hIL2 | DKTHTCPPCPAPELLGGPSVFLFPP KPKDTLMISRTPEVTCVVVDVSHED PEVKFNWYVDGVEVHNAKTKPREEQ | GGSSPPGGGSSGG GSGP (SEQ ID NO: 23) | APTSSSTKKTQLQLEHLLLDLQMIL NGINNYKNPKLTAMLTAKFAMPKKA TELKHLQCLEEALKPLEEVLNLAQS |

-continued

| | | | | |
|---|---|---|---|---|
| AK442 | (R38A, F42A, Y45A, E62A, L80F, R53D, L85V, I86V, I92F, C125A) | YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | | KNFHFDPRDWSNINVFVLELKGSET TFMCEYADETATI VEFLNRMITFAQSIISTLT (SEQ ID NO: 328) |
| AK442 | DNA255 Knob: hFc(N297A)-hIL2 (R38A, F42A, Y45A, E62A, C125A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GGSSPPGGGSSGG GSGP (SEQ ID NO: 23) | APTSSSTKKTQLQLEHLLLDLQMIL NGINNYKNPKLTAMLTAKFAMPKKA TELKHLQCLEEALKPLEEVLNLAQS KNFHLRPRDLISNINIVLELKGSE TTFMCEYADETATIVEFLNRWITFA QSIISTLT (SEQ ID NO: 3) |
| AK442 | DNA553 Hole: hFc(N297A)-[DSGGFMLT]-hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLVSKLTVDKSRWQQG MVFSCSVMHEALHNHYTQKSLSLSP G (SEQ ID NO: 9) | GPPSGSSPG (SEQ ID NO: 36) | DSGGFMLT (SEQ ID NO: 25) |
| AK443 | DNA187 Hole: hFc(N297A)-hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLVSKLTVDKSRWQQG MVFSCSVMHEALHNHYTQKSLSLSP G (SEQ ID NO: 9) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |

| | | | | |
|---|---|---|---|---|
| AK443 | DNA554 | Knob: hFc(N297A)-[VPLSLY]-hIL2(E15R, L18C, D20R, R38A, F42A, Y45A, E62A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSPG (SEQ ID NO: 34) | VPLSLY (SEQ ID NO: 28) |
| AK444 | DNA281 | Knob: hFc(N297A)-[VPLSLY]-hIL2(R38A, F42A, Y45A, E62A, C125A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSGP (SEQ ID NO: 33) | DSGGFMLT (SEQ ID NO: 25) |
| AK444 | DNA440 | Hole: hFc(N297A)-hCD122 (C122S, C168S) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLVSKLTVDKSRWQQG MVFSCSVMHEALHNHYTQKSLSLSP G (SEQ ID NO: 9) | PGSGS (SEQ ID NO: 14) | AVNGTSQFTCFYNSRANISCVWSQD GALQDTSCQVHAWPDRRRWNQTCEL LPVSQASWACNLILGAPDSQKLTTV DIVTLRVLCREGVRWRVMAIQPFKP FENLRLMAPISLQVVHETHRSNIS WEISQASHYFERHLEFEARTLSPGH TWEEAPLLTLKQKQEWISLETLTPD TQYEFQVRVKPLQGEFTTWSPWSQP LAFRTKPAALGKD (SEQ ID NO: 5) |
| AK449 | DNA547 | Hole: hFeIgG1 (N297A + EPKSS)- Hole: hFc(N297A)-hCD122 | EPKSSDKTHTCPPCPAPELLGGPSV FLFPPKPKDTLMISRTPEVTCVVVD VSHEDPEVKFNWYVDGVEVHNAKTK PREEQYASTYRVVSVLTVLHQDWLN GKEYKCKVSNKALPAPIEKTISKAK GQPREPQVCTLPPSRDELTKNQVSL | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHETHRCNIS WEISQASHYFERHLEFEARTLSPGH |

| | | | |
|---|---|---|---|
| AK449 | DNA550 | Knob: hFcIgG1 (N297A + EPKSS)-hIL2 (R38A, F42A, Y45A, E62A, C125A) | SCAVKGFYPSDIAVEWESNGQPENN YKTTPPVLDSDGSFFLVSKLTVDKS RWQQGNVFSCSVMHEALHNHYTQKS LSLSPG (SEQ ID NO: 285) EPKSSDKTHTCPPCPAPELLGGPSV FLFPPKPKDTLMISRTPEVTCVVVD VSHEDPEVKFNWYVDGVEVHNAKTK PREEQYASTYRVVSVLTVLHQDWLN GKEYKCKVSNKALPAPIEKTISKAK GQPREPQVYTLPPCRDELTKNQVSL WCLVKGFYPSDIAVEWESNGQPENN NYKTTPPVLDSDGSFFLYSKLTVDK SRWQQGNVFSCSVMHEALHNHYTQK SLSLSPG (SEQ ID NO: 288) | GSPG (SEQ ID NO: 34) | VPLSLY (SEQ ID NO: 28) |
| AK450 | DNA548 | Hole: hFcIgG1 (N297A + AKT)-hFc (N297A)-hCD122 | AKTDKTHTCPPCPAPELLGGPSVFL FPPKPKDTLMISRTPEVTCVVVDVS HEDPEVKFNWYVDGVEVHNAKTKPR EEQYASTYRVVSVLTVLHQPWLNGK EYKCKVSNKALPAPIEKTISKAKGQ PREPQVCTLPPSRDELTKP NQVSLSCAVKGFYPSDIAVEWESNG QPENNYKTTPPVLDSDGSFFLYSKL TVDKSRWQQGNVFSCSVMHEALHNH YTQKSLSLSPG (SEQ ID NO: 286) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK450 | DNA551 | Knob: hFcIgG1 (N297A + AKT)-[VPLSLY]-hIL2 (R38A, F42A, Y45A, E62A, C125A) | AKTDKTHTCPPCPAPELLGGPSVFL FPPKPKDTLMISRTPEVTCVVVDVS HEDPEVKFNWYVDGVEVHNAKTKPR EEQYASTYRVVSVLTVLHQDWLNGK EYKCKVSNKALPAPIEKTISKAKGQ PREPQVYTLPPCRDELTKNQVSLWC LVKGFYPSDIAVEWESNGQPENNYK TTPPVLDSDGSFFLYSKLTVDKSRW QQGNVFSCSVMHEALHNHYTQKSLS LSPG (SEQ ID NO: 289) | GSPG (SEQ ID NO: 34) | VPLSLY (SEQ ID NO: 28) |
| AK451 | DNA549 | Hole: hFcIgG1 (N297A | AKTEPKSSDKTHTCPPCPAPELLGG PSVFLFPPKPKDVLMISRTPEVTCV VVDVSHEDPEVKFNWYVDGVEVHNA | PGSGS (SEQ ID NO: 14) | AVNGTSQFTCFYNSRANISCVWSQD GALQDTSCQVHAWPDRRRWNQTCEL LFVSQASWACNLILGAPDSQKLTTV |

| | | | | |
|---|---|---|---|---|
| AK451 | AKTEPKSS)-hCD122 | CTKPREEQYASTYRVVSLTVLHQD WLNGKEYKCKVSNKALPAPIEICTI SKAKGQPREPQVCTLPPSRDELTKN QVSLSCAVKGFYPSDIAVEWESNGQ PENNYKTPPVLDSDG SFFLVSKLTVDKSRWQQGNVFSCSSV MHEALHNHYTQKSLSLSPG (SEQ ID NO: 287) | | DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK452 | DNA552 Knob: hFcIgG1 (N297A AKTAKTE PKSS)-[VPLSLY]-hIL2(R38A, F42A, Y45A, E62A, C125A) | AKTFPKSSDKTFITCPPCPAPELLG GPSVFLFPPKPKDTLMISRTPEVTC VVVDVSHEDPEVKFNWYVDGVEVHN AKTKPREEQYASTYRVVSVLTVLHQ DWLNGKEYKCKVSNKALPAPiEKTI SKAKGQPREPQVVTLPPCRDELTKN QVSLWCLVKGFYPSDIAVEWESNGQ PENNYKTPPVLDSDGSFFLYSKLT VDKSRWQQGNVFSCSVMHEALHNHY TQKSLSLSPG (SEQ ID NO: 290) | GSPG (SEQ ID NO: 34) | VPLSLY (SEQ ID NO: 28) |
| AK452 | DNA187 Hole: hFc(N297A)-hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLVSKLTVDKSRWQQG MVFSCSVMHEALHNHYTQKSLSLSP G (SEQ ID NO: 9) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK452 | DNA563 Knob: hFc(N297A)-[VPLSLY]-hIL2(E15R, L18C, D20R, R38A, F42A, Y45A, E62A) | DKTHTCPPCPAPELLGGPSVFLFPP KPKDTLMISRTPEVTCVVVDVSHED PEVKFNWVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSPG (SEQ ID NO: 34) | VPLSLY (SEQ ID NO: 28) |

| | | | | |
|---|---|---|---|---|
| AK453 | DNA187 | Hole: hFc(N297A)-hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLYSKLTVDKSRWQQG MVFSCSVMHEALHNHYTQKSLSLSP G (SEQ ID NO: 9) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK453 | DNA565 | Knob: hFc(N297A)-[VPLSLY]-hIL2(E15L, L18C, D20R, R38A, F42A, Y45A, E62A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPCRDELTKNQVSLWCLVK GFYPSDIAVEWESNGQPENNYKTTP PVLDSDGSFFLYSKLTVDKSRWQQG MVFSCSVMHEALHNHYTQKSLSLSP G (SEQ ID NO: 12) | GSPG (SEQ ID NO: 34) | VPLSLY (SEQ ID NO: 28) |
| AK454 | DNA187 | Hole: hFc(N297A)-hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLYSKLTVDKSRWQQG MVFSCSVMHEALHNHYTQKSLSLSP G (SEQ ID NO: 9) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK454 | DNA566 | Knob: hFc(N297A)-[VPLSLY]-hIL2(E15R, L18C, D20R, R38A, F42A, Y45A, | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP | GSPG (SEQ ID NO: 34) | VPLSLY (SEQ ID NO: 28) |

| | | | | |
|---|---|---|---|---|
| AK455 | DNA187 | | PVLDSDGSFFLYSKLTVDKSRWQQG NVFSCSVMHEALHNHYTQKSLSLSP G (SEQ ID NO: 12) | |
| | | E62A) | | |
| AK455 | DNA187 | Hole: hFc(N297A)- hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLYSKLTVDKSRWQQG MVFSCSVMHEALHNHYTQKSLSLSP G (SEQ ID NO: 9) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK455 | DNA567 | Knob: hFc(N297A)- [VPLSLY]- hIL2(L18C, D20R, R38A, F42A, Y45A, E62A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCIVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSPG (SEQ ID NO: 34) | VPLSLY (SEQ ID NO: 28) |
| AK456 | DNA187 | Hole: hFc(N297A)- hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLYSKLTVDKSRWQQG MVFSCSVMHEALHNHYTQKSLSLSP G (SEQ ID NO: 9) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK456 | DNA568 | Knob: hFc(N297A)- [VPLSLY]- hIL2(E15F, | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK | GSPG (SEQ ID NO: 34) | VPLSLY (SEQ ID NO: 28) |

| | | | |
|---|---|---|---|
| | | L18C, D20R, R38A, F42A, Y45A, E62A) | CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHE ALHNHYTQKSLSLSPG (SEQ ID NO: 12) | |
| AK462 | DNA530 | Knob: mFcIgG1 (DAPG)-hIL2(R38A, F42A, Y45A, E62A) | VRSGCKPCICTVPEVSSVFIFPPKP KDVLTITLTPKVTCVVVAISKDDPE VQFSWFVDDVEVHTAQTQPREEQFN STFRSVSELPIMHQDWLKGKEFKCR VNSAAFGAPIEKTISKTKGRPKAPQ VYTIPPPKEQMAKDKVSLTCMITDF FPEDITVEWQWNGQPAENYDNTQPI MDTDGSYFVYSKLNVQKSNWEAGNT FTCSVLHEGLHNHHTEKSLSHSPG (SEQ ID NO: 283) | GGSSPP GGGSS GG GSGP (SEQ ID NO: 23) | APTSSSTKKTQLQLEHLLLDLQMIL NGINNYKNPKLTAMLTAKFAMPKKA TELKHLQCLEEALKPLEEVLNLAQS KNFHLRPRDLISNINIVLELKGSE TTFMCEYADETATIVEFLNRWITFA QSIISTLT (SEQ ID NO: 3) |
| AK462 | DNA532 | Hole: mFcIgG1 (DAPG) | VRSGCKPCICTVPEVSSVFIFPPKP KDVLTITLTPKVTCVVVAISKDDPE VQFSWFVDDVEVHTAQTQPREEQFN STFRSVSELPIMHQDWLKGKEFKCR VNSAAFGAPIEKTISKTKGRPKAPQ VYTIPPPKKQMAKDKVSLTCMITDF FPEDITVEWQWNGQPAENYKNTQPI MKTDGSYFVYSKLNVQKSNWEAGNT FTCSVLHNHHTEKSLSHSPG (SEQ ID NO: 284) | | |
| AK463 | DNA530 | Knob: mFcIgG1 (DAPG)-hIL2(R38A, F42A, Y45A, E62A) | VRSGCKPCICTVPEVSSVFIFPPKP KDVLTITLTPKVTCVVVAISKDDPE VQFSWFVDDVEVHTAQTQPREEQFN STFRSVSELPIMHQDWLKGKEFKCR VNSAAFGAPIEKTISKTKGRPKAPQ VYTIPPPKEQMAKDKVSLTCMITDF FPEDITVEWQWNGQPAENYDNTQPI MDTDGSYFVYSDLNVQKSNWEAGNT FTCSVLHEGLHNHHTEKSLSHSPG (SEQ ID NO: 283) | GSSPPG GGSSGG GSGP (SEQ ID NO: 23) | APTSSSTKKTQLQLEHLLLDLQMIL NGINNYKNPKLTAMLTAKFAMPKKA TELKHLQCLEEALKPLEEVLNLAQS KNFHLRPRDLISNINIVLELKGSE TTFMCEYADETATIVEFLNRWITFA QSIISTLT (SEQ ID NO: 3) |
| AK463 | DNA533 | Hole: mFcIgG1 (DAPG)-hCD122 | VRSGCKPCICTVPEVSSVFIFPPKP KDVLTITLTPKVTCVVVAISKDDPE VQFSWFVDDVEVHTAQTQPREEQFN STFRSVSELPIMHQDWLKGKEFKCR | PGSGS (SEQ ID NO: 14) | AVNGTSQFTCFYNSRANISCVWSQD GALQDTSCQVHAWPDRRWNQTCEL LFVSQASWACNLILGAPDSQKLTTV DIVTLRVLCREGVRWRVMAIQDFKP |

| | | | |
|---|---|---|---|
| AK464 | DNA530 | Knob: mFcIgG1 (DAPG)- hIL2(R38A, F42A, Y45A, E62A) | VRSGCKPCICTVPEVSSVFIFPPKP KDVLTITLTPKVTCVVVAISKDDPE VQFSWFVDDVEVHTAQTQPREEQFN STFRSVSELPIMHQDWLKGKEFKCR VNSAAFGAPIEKTISKTKGRPKAPQ VYTIPPPKEQMAKDKVSLTCMITDF FPEDITVEWQWNGQPAENYDNTQPI MDTDGSYFVYSDLNVQKSNWEAGNT FTCSVLHEGLHNHHTEKSLSHSPG (SEQ ID NO: 283) | GSSPPGGGSSGG GSGP (SEQ ID NO: 23) | APTSSSTKKTQLQLEHLLLDLQMIL NGINNYKNPKLTAMLTAKFAMPKKA TELKHLQCLEEALKPLEEVLNLAQS KNFHLRPRDLISNINIVLELKGSE TTFMCEYADETATIVEFLNRWITFA QSIISTLT (SEQ ID NO: 3) |
| AK464 | DNA534 | Hole: mFcIgG1 (DAPG)- hCD122 | VRSGCKPCICTVPEVSSVFIFPPKP KDVLTITLTPKVTCVVVAISKDDPE VQFSWFVDDVEVHTAQTQPREEQFN STFRSVSELPIMHQDWLKGKEFKCR VNSAAFGAPIEKTISKTKGRPKAPQ VYTIPPPKKQMAKDKVSLTCMITDF FPEDITVEWQWNGQPAENYKNTQPI MKTDGSYFVYSKLNVQKSNWEAGNT FTCSVLHEGLHNHHTEKSLSHSPG (SEQ ID NO: 284) | PGSGS (SEQ ID NO: 14) | AVKNCSHLECFYNSRANVSCMWSHE EALNVTTCHVHAKSNLRHWNKTCEL TLVRQASWACNLILGSFPESQSLTS VDLLDINVVCWEEKGWRRVKTCDFH PFDNLRLIVAPHSLQVLHIDTQRCNI SWKVSQVSHYIEPYLEFEARRRLLG HSWEDASVLSLKQRQQMLFLEMLIP STSYEVQVRVKAORNN TGTWSPWSQPLTFRTRPADPVIKF (SEQ ID NO: 326) |
| AK465 | DNA531 | Knob: mFcIgG1 (DAPG)- [VPLSLY] hIL2(R38A, F42A, Y45A, E62A) | VRSGCKPCICTVPEVSSVFIFPPKP KDVLTITLTPKVTCVVVAISKDDPE VQFSWFVDDVEVHTAQTQPREEQFN STFRSVSELPIMHQDWLKGKEFKCR VNSAAFGAPIEKTISKTKGRPKAPQ VYTIPPPKEQMAKDKVSLTCMITDF FPEDITVEWQWNGQPAENYDNTQPI MDTDGSYFVYSDLNVQKSNWEAGNT FTCSVLHEGLHNHHTEKSLSHSPG (SEQ ID NO: 283) | GSPG (SEQ ID NO: 34) | VPLSY (SEQ ID NO: 28) |
| AK466 | DNA5332 | Hole: mFcIgG1 (DAPG) | VRSGCKPCICTVPEVSSVFIFPPKP KDVLTITLTPKVTCVVVAISKDDPE VQFSWFVDDVEVHTAQTQPREEQFN STFRSVSELPIMHQDWLKGKEFKCR VNSAAFGAPIEKTISKTKGRPKAPQ | | FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |

| | | | | |
|---|---|---|---|---|
| | | | | VTTIPPPKKQMAKDKVSLTCMITDF FPEDITVEWQWNGQPAENYKNTQPI MKTDGSYFVYSKLNVQKSNWEAGNT FTCSVLHEGLHNHHTEKSLSHSPG (SEQ ID NO: 284) | |
| AK466 | DNA531 | Knob: mFcIgG1 (DAPG)-[VPLSLY]-hIL2 (R38A, F42A, Y45A, E52A, C125A) | VRSGCKPCICTVPEVSSVFIFPPKP KDVLTITLTPKVTCVVVAISKDDPE VQFSWFVDDVEVHTAQTQPREEQFN STFRSVSELPIMHQDWLKGKEFKCR VNSAAFGAPIEKTISKTKGRPKAPQ VTTIPPPKEQMAKDKVSLTCMITDF FPEDITVEWQWNGQPAENYDNTQPI MDTDGSYFVYSDLNVQKSNWEAGNT FTCSVLHEGLHNHHTEKSLSHSPG (SEQ ID NO: 283) | GSPG (SEQ ID NO: 34) VPLSY (SEQ ID NO: 28) |
| AK466 | DNA533 | Hole: mFcIgG1 (DAPG)-hCD122 | VRSGCKPCICTVPEVSSVFIFPPKP KDVLTITLTPKVTCVVVAISKDDPE VQFSWFVDDVEVHTAQTQPREEQFN STFRSVSELPIMHQDWLKGKEFKCR VNSAAFGAPIEKTISKTKGRPKAPQ VTTIPPPKKQMAKDKVSLTCMITDF FPEDITVEWQWNGQPAENYKNTQPI MKTDGSYFVYSKLNVQKSNWEAGNT FTCSVLHEGLHNHHTEKSLSHSPG (SEQ ID NO: 284) | PGSGS (SEQ ID NO: 14) AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK467 | DNA531 | Knob: mFcIgG1 (DAPG)-[VPLSLY]-hIL2 (R38A, F42A, Y45A, E52A, C325A) | VRSGCKPCICTVPEVSSVFIFPPKP KDVLTITLTPKVTCVVVAISKDDPE VQFSWFVDDVEVHTAQTQPREEQFN STFRSVSELPIMHQDWLKGKEFKCR VNSAAFGAPIEKTISKTKGRPKAPQ VTTIPPPKEQMAKDKVSLTCMITDF FPEDITVEWQWNGQPAENYDNTQPI MDTDGSYFVYSDLNVQKSNWEAGNT FTCSVLHEGLHNHHTEKSLSHSPG (SEQ ID NO: 283) | GSPG (SEQ ID NO: 34) VPLSY (SEQ ID NO: 28) |
| AK467 | DNA534 | Hole: mFcIgG1 (DAPG)-hCD122 | VRSGCKPCICTVPEVSSVFIFPPKP KDVLTITLTPKVTCVVVAISKDDPE VQFSWFVDDVEVHTAQTQPREEQFN STFRSVSELPIMHQDWLKGKEFKCR VNSAAFGAPIEKTISKTKGRPKAPQ VTTIPPPKKQMAKDKVSLTCMITDF | PGSGS (SEQ ID NO: 14) AVKNCSHLECFYNSRANVSCMWSHE EALNVTTCHVHAKSNLRHWNKTCEL TLVRQASWACNLILGSFPESQSLTS VDLLDINVVCWEEKGWRRVKTCDFH PFDNLRLVAPHSLQVLHIDTQRCNI SWKVSQVSHYIEPYLEFEARRLLG |

| | | -continued | |
|---|---|---|---|
| AKA68 | DNA576 | Hole: hFc(N237A, M252Y, S254T, T256E)-hCD122 | FPEDITVEWQWNGQPAENYKNTQPI MKTDGSYFVYSKLNVQKSNWEAGNT FTCSVLHEGLHNHTEKSLSHSPG (SEQ ID NO: 284) | HSWEDASVLSLKQRQQMLFLEMLIP STSYEVQVRVKAORNN TGTWSPWSQPLTFRTRPADPVIKF (SEQ ID NO: 326) |
| AK468 | DNA580 | Knob: hFc(N297A, M252Y, S254T, T256Y)-[VPLSLY]-hIL2(R38A, F42A, Y45A, E52A, C125A) | DKTHTCPPCPAPELLGGPSVFLFPP KPKDTLYITREPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDG SPFLVSKLTVDKSRWQQGMVFSCSV MHEALHNHYTQKSLSLSPG (SEQ ID NO: 292) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK468 | DNA575 | Hole: hFc(N297A, I253A)-hCD122 | DKTHTCPPCPAPELLGGPSVFLFPP KPKDTLMASRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNIGQPENNYKTT PPVLDSDGSFFLVSK LTVDKSRWQQGNVFSCSVMHEALHN HYTQKSLSLSPG (SEQ ID NO: 10) | GSPG (SEQ ID NO: 34) | VPLSY (SEQ ID NO: 28) |
| AK469 | DNA575 | Hole: hFc(N297A, I253A)-hCD122 | DKTHTCPPCPAPELLGGPSVFLFPP KPKDTLMASRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNIGQPENNYKTT PPVLDSDGSFFLVSK LTVDKSRWQQGNVFSCSVMHEALHN HYTQKSLSLSPG (SEQ ID NO: 10) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK469 | DNA577 | Knob: hFc(N297, I253A)-hIL2 | DKTHTCPPCPAPELLGGPSVFLFPP KPKDTLMASRTPEVTCVVVDVSHED PEVKFNWYVDGVEVHNAKTKPREEQ YASTYRVVSVLTVLHQDWLNGKEYK | GSSPPG GGSSGG GSSGP (SEQ ID | APTSSSTKKTQLQLEHLLLDLQMIL NGINNYKNPKLTAMLTAKFAMPKKA TELKHLQCLEEALKPLEEVLNLAQS KNFHLRPRDLISNINIVLELKGSE |

-continued

| | | | | |
|---|---|---|---|---|
| | | (R38A, F42A, Y45A, E52A, C125A) | CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 13) | NO: 23) | TTFMCEYADETATIVEFLNRWITFA QSIISTLT (SEQ ID NO: 3) |
| AK470 | DNA576 | Hole: hFc(N297A, M252Y, S254T, T256E)- hCD122 | DKTHTCPPCPAPELLGGPSVFLFPP KPKDTLYITREPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPSRDELTKNQVSLSCAVK GFYPSDIAVEWESNGQPENNYKTTP PVLDSDGSPFLVSKLTVDKSRWQGQ MVFSCSVMHEALHNHYTQKSLSLSP G (SEQ ID NO: 292) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK470 | DNA578 | Knob: hFc(N297A, M252Y, S254T, T256E)- hIL2(R38A, F42A, Y45A, E62A, C125A) | DKTHTCPPCPAPELLGGPSVFLFPP KPKDTLYITREPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 294) | GSSPP GGGSS GG GSGP (SEQ ID NO: 23) | APTSSSTKKTQLQLEHLLLDLQMIL NGINNYKNPKLTAMLTAKFAMPKKA TELKHLQCLEEA LKPLEEVLNLAQSKNFHLRPRDLIS NINVIVLELKGSETTFMCEYADETA TIVEFLNRWITFAQSIISTLT (SEQ ID NO: 3) |
| AK471 | DNA575 | Hole: hFc(N297A, I253A)- HCD122 | DKTHTCPPCPAPELLGGPSVFLFPP KPKDTLMASRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDFAVEWESNIGQPENNYKTT PPVLDSDGSFFLVSK LTVDKSRWQQGNVFSCSVMHEALHN HYTQKSLSLSPG (SEQ ID NO: 10) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |

| | | | |
|---|---|---|---|
| AK471 | DNA579 | Knob: hFc(M297, I253A)-[VPLSLY]-hIL2(R38A, F42A, Y45A, E62A, C125A) | DKTHTCPPCPAPELLGGPSVFLFPP KPKDTLMASRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 13) | GSPG (SEQ ID NO: 34) | VPLSLY (SEQ ID NO: 28) |
| AK475 | DNA255 | Knob: hFc(N297A)-hIL2 (R38A, F42A, Y45A, E62A, C123A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSSPPG GGSSGG GSGP (SEQ ID NO: 23) | APTSSSTKKTQLQLEHLLLDLQMIL NGINNYKNPKLTAMLTAKFAMPKKA TELKHLQCLEEALKPLEEVLNLAQS KNFHLRPRDLISNINIVLELKGSE TTFMCEYADETATIVEFLNRWITFA QSIISTLT (SEQ ID NO: 3) |
| AK475 | DNA528 | Hole: hFc(N297A)-hCD122 (C168S) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLYSKLTVDKSRWQQG MVFSCSVMHEALHNHYTQKSLSLSP G (SEQ ID NO: 9) | PGSGS (SEQ ID NO: 14) | AVNGTSQFTCFYNSRANISCVWSQD GALQDTSCQVHAWPDRRRWNQTCEL LPVSQASWACNLILGAPDSQLTTVD IVTLRVLCREGVRWRVMAIQDFKPF ENLRLMAPISLQVVHVETHRCNISW EISQASHYFERHLEFEARTLSPGHT WEEAPLLTLKQKQEWISLETLTPDT QYEFQVRVKPLQGEFTTWSPWSQPL AFRTKPAALGKD (SEQ ID NO: 327) |
| AK476 | DNA263 | Knob: hFc(N297A)-[VPLSLY]-hIL2 (R38A, F42A, Y45A, E62A, C123A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG | GSPG (SEQ ID NO: 34) | VPLSLY (SEQ ID NO: 28) |

| | | | | |
|---|---|---|---|---|
| AK476 | DNA528 | Hole: hFc(N297A)-hCD122 (C168BS) | NVFSCSVMHE ALHNHYTQKSLSLSPG (SEQ ID NO: 12) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLYSKLTVDKSRWQQG MVFSCSVMHEALHNHYTQKSLSLSP G (SEQ ID NO: 9) | PGSGS (SEQ ID NO: 14) | AVNGTSQFTCFYNSRANISCVWSQD GALQDTSCQVHAWPDRRRWNQTCEL LPVSQASWACNLILGAPDSQLTTVD IVTLRVLCREGVRWRVMAIQDFKPF ENLRLMAPISLQVHVETHRCNISW EISQASHYFERHLEFEARTLSPGHT WEEAPLLTLKQKQEWISLETLTPDT QYEFQVRVKPLQGEFTTWSPWSQPL AFRTKPAALGKD (SEQ ID NO: 327) |
| AK477 | DNA158 | Hole: hFc(N297A) | NVFSCSVMHE ALHNHYTQKSLSLSPG (SEQ ID NO: 12) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLYSKLTVDKSRWQQG MVFSCSVMHEALHNHYTQKSLSLSP G (SEQ ID NO: 9) | | |
| AK477 | DNA554 | Knob: hFc(N297A)-[VPLSLy]-hIL2 (E15R, L18C, D20R, R38A, F42A, Y45A, E62A) | | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHE ALHNHYTQKSLSLSPG (SEQ ID NO: 12) | GSPG (SEQ ID NO: 34) | VPLSLY (SEQ ID NO: 28) |
| AK484 | DNA158 | Hole: hFc(N297A) | | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE | | |

-continued

| | | | | |
|---|---|---|---|---|
| AK484 | DNA581 | Knob: hFc(N297A)-[VPLSLY]-hIL2 (L18C, R38A, F42A, Y45A, E62A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSPG (SEQ ID NO: 34) VPLSLY (SEQ ID NO: 28) |
| AK485 | DNA158 | Hole: hFc (N297A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPSRDELTKNQVSLSCAVK GFYPSDIAVEWESNGQPENNYKTTP PVLDSDGSFFLYSKLTVDKSRWQQG MVFSCSVMHEALHNHYTQKSLSLSP G (SEQ ID NO: 9) | |
| AK485 | DNA582 | Knob: hFc(N297A)-[VPLSLY]-hIL2 (H16Y, R38A, F42A, Y45A, E62A, C125A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSPG (SEQ ID NO: 34) VPLSLY (SEQ ID NO: 28) |
| AK486 | DNA158 | Hole: hFc (N297A) | DKTHTCPPCPAPELLGGPSVFLFPP KPKDTLMISRTPEVTCVVVDVSHED | |

-continued

| | | | | |
|---|---|---|---|---|
| AK486 | DNA583 | Knob: hFc(N297A)-[VPLSLY]-hIL2 (H16E, R38A, F42A, Y45A, E62A, C125A) | PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLYSKLTVDKSRWQQG MVFSCSVMHEALHNHYTQKSLSLSP G (SEQ ID NO: 9) | VPLSLY (SEQ ID NO: 28) |
| | | | | GSPG (SEQ ID NO: 34) |
| AK487 | DNA158 | Hole: hFc (N297A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | |
| AK487 | DNA584 | Knob: hFc(N297A)-[VPLSLY]-hIL2 (D20L, R38A, F42A, Y45A, E62A, C125A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | VPLSLY (SEQ ID NO: 28) |
| | | | | GSPG (SEQ ID NO: 34) |

| AK488 | DNA158 | Hole: hFc (N297A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLYSKLTVDKSRWQQG MVFSCSVMHEALHNHYTQKSLSLSP G (SEQ ID NO: 9) | |
|---|---|---|---|---|
| AK488 | DNA585 | Knob: hFc(N297A)- [VPLSLY]- hIL2 (H16Y, L18C, R38A, F42A, Y45A, E62A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSPG (SEQ ID NO: 34) VPLSLY (SEQ ID NO: 28) |
| AK489 | DNA158 | Hole: hFc (N297A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLYSKLTVDKSRWQQG MVFSCSVMHEALHNHYTQKSLSLSP G (SEQ ID NO: 9) | |
| AK489 | DNA586 | Knob: hFc(N297A)- [VPLSLY]- hIL2 (H16E, L18C, R38A, | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK | GSPG (SEQ ID NO: 34) VPLSLY (SEQ ID NO: 28) |

| | | | |
|---|---|---|---|
| Ak490 | DNA158 | GFYPSDIAVEWESNGQPENNYKTTP PVLDSDGSFFLYSKLTVDKSRWQQG NVFSCSVMHEALHNHYTQKSLSLSP G (SEQ ID NO: 12) | F42A, Y45A, E62A) |
| Ak490 | DNA158 | Hole: hFc (N297A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLYSKLTVDKSRWQQG MVFSCSVMHEALHNHYTQKSLSLSP G (SEQ ID NO: 9) |
| Ak490 | DNA587 | Knob: hFc(N297A)- [VPLSLY]- hIL2 (L18C, d20L, R38A, F42A, Y45A, E62A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: ) GSPG (SEQ ID NO: 34) VPLSLY (SEQ ID NO: 28) |
| Ak491 | DNA158 | Hole: hFc (N297A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLYSKLTVDKSRWQQG MVFSCSVMHEALHNHYTQKSLSLSP G (SEQ ID NO: 9) |
| Ak491 | DNA588 | Knob: hFc(N297A)- [VPLSLY]- | DKTHTCPPCPAPELLGGPSVFLFPP KPKDTLMISRTPEVTCVVVDVSHED PEVKFNWYVDGVEVHNAKTKPREEQ GSPG (SEQ ID NO: 34) VPLSLY (SEQ ID NO: 28) |

-continued

| | | | |
|---|---|---|---|
| Ak492 | hIL2 (H16Y, L18C, D20L, R38A, F42A, Y45A, E62A) | YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | |
| DNA158 | Hole: hFc (N297A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLYSKLTVDKSRWQQG MVFSCSVMHEALHNHYTQKSLSLSP G (SEQ ID NO: 9) | |
| Ak492 | Knob: hFc(N297A)- [VPLSLY]- hIL2 (H16E, L18C, D20L, R38A, F42A, Y45A, E62A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | VPLSLY (SEQ ID NO: 28) GSPG (SEQ ID NO: 34) |
| AK493 | DNA187 | Hole: hFc (N297A)- hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLYSKLTVDKSRWQQG MVFSCSVMHEALHNHYTQKSLSLSP G (SEQ ID NO: 9) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |

| | | | | |
|---|---|---|---|---|
| Ak493 | DNA581 | Knob: hFc(N297A)-[VPLSLY]-hIL2 (L18C, R38A, F42A, Y45A, E62A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSPG (SEQ ID NO: 34) | VPLSLY (SEQ ID NO: 28) |
| Ak494 | DNA187 | Hole: hFc(N297A)-hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWMLNGKEYK CKVSNKALPAPIEKTISKAKGQPRE PQVCTLPPSRDELTKNQVSLSCAVK GFYPSDIAVEWESNGQPENNYKTTP PVLDSDGSFFLYSKLTVDKSRWQQG MVFSCSVMHEALHNHYTQKSLSLSP G (SEQ ID NO: 9) | | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| Ak494 | DNA582 | Knob: hFc(N297A)-[VPLSLY]-hIL2 (H16Y, R38A, F42A, Y45A, E62A, C125A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSPG (SEQ ID NO: 34) | VPLSLY (SEQ ID NO: 28) |
| Ak495 | DNA187 | Hole: hFc(N297A)-hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWMLNGKEYK CKVSNKALPAPIEKTISKAKGQPRE PQVCTLPPSRDELTKNQVSLSCAVK | | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH |

| | | | | |
|---|---|---|---|---|
| AK495 | DNA583 | Knob: hFc(N297A)-[VPLSLY]-hIL2 (H16E, R38A, F42A, Y45A, E62A, C125A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSPG (SEQ ID NO: 34) | VPLSLY (SEQ ID NO: 28) | TWEEAPLLTLKQKQEWICLETLTPD TQYEFQVRVKPLQGEFTTWSPWSQP LAFRTKPAALGKD (SEQ ID NO: 4) |
| AK496 | DNA187 | Hole: hFc(N297A)-hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPSRDELTKNQVSLSCAVK GFYPSDIAVEWESNGQPENNYKTTP PVLDSDGSFFLYSKLTVDKSRWQQG NVFSCSVMHEALHNHYTQKSLSLSP G (SEQ ID NO: 9) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK496 | DNA584 | Knob: hFc(N297A)-[VPLSLY]-hIL2 (D20L, R38A, F42A, Y45A, E62A, C125A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSPG (SEQ ID NO: 34) | VPLSLY (SEQ ID NO: 28) | |
| AK497 | DNA187 | Hole: hFc(N297A)-hCD122 | DKTHTCPPCPAPELLGGPSVFLFPP KPKDTLMISRTPEVTCVVVDVSHED PEVKFNWYVDGVEVHNAKTKPREEQ | PGSGS (SEQ ID NO: 14) | AVNGTSQFTCFYNSRANISCVWSQD GALQDTSCQVHAWPDRRRWNQTCEL LFVSQASWACNLILGAPDSQKLTTV |

| | | -continued | |
|---|---|---|---|
| AK497 | DNA585 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSPG (SEQ ID NO: 34) | Knob: hFc(N297A)- [VPLSLY]- hIL2 (H16Y, L18C, R38A, F42A, Y45A, E62A) | YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLVSKLTVDKSRWQQG MVFSCSVMHEALHNHYTQKSLSLSP G (SEQ ID NO: 9) | DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK498 | DNA187 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 9) | PGSGS (SEQ ID NO: 14) | Hole: hFc (N297A)- hCD122 | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK498 | DNA586 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSPG (SEQ ID NO: 34) | Knob: hFc(N297A)- [VPLSLY]- hIL2 (H16E, L18C, R38A, F42A, Y45A, E62A) | | VPLSLY (SEQ ID NO: 28) |

| | | | | |
|---|---|---|---|---|
| AK499 | DNA187 | Hole: hFc (N297A)-hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLYSKLTVDKSRWQQG MVFSCSVMHEALHNHYTQKSLSLSP G (SEQ ID NO: 9) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK499 | DNA587 | Knob: hFc(N297A)-[VPLSLY]-hIL2 (L18C, d20L, R38A, F42A, Y45A, E62A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSPG (SEQ ID NO: 34) | VPLSLY (SEQ ID NO: 28) |
| AK500 | DNA187 | Hole: hFc (N297A)-hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLYSKLTVDKSRWQQG MVFSCSVMHEALHNHYTQKSLSLSP G (SEQ ID NO: 9) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK500 | DNA588 | Knob: hFc(N297A)-[VPLSLY]-hIL2 (H16Y, L18C, D20L, R38A, F42A, Y45A, E62A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ | GSPG (SEQ ID NO: 34) | VPLSLY (SEQ ID NO: 28) |

| | | | |
|---|---|---|---|
| AK501 | DNA187 | Hole: hFc(N297A)-hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPSRDELTKNQVSLSCAVK GFYPSDIAVEWESNGQPENNYKTTP PVLDSDGSFFLYSKLTVDKSRWQQG MVFSCSVMHEALHNHYTQKSLSLSP G (SEQ ID NO: 9) | PGSGS (SEQ ID NO: 14) | AVNGTSQFTCFYNSRANISCVWSQD GALQDTSCQVHA WPDRRRMNQTCELLFVSQASMACNL ILGAPDSQKLTT VDIVTLRVLCREGVRRVMAIQDFK PFENLRLMAPIS LQVVHVETHRCNISWEISQASHYFE RHLEFEARTLSP GHTWEEAPLLTLKQKQEWICLETLT PDTQYEFQVRVK PLQGEFTTWSPWSQPLAFRTKPAAL GKD (SEQ ID NO: 4) |
| AK501 | DNA589 | Knob: hFc(N297A)-[VPLSLY]-hIL2 (H16Y, L18C, D20L, R38A, F42A, Y45A, E62A) | DKTHTCPPCPAPELLGGPSVFLFPP KPKDTLMISRTPEVTCVVVDSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSPG (SEQ ID NO: 34) | VPLSLY (SEQ ID NO: 28) |
| AK502 | DNA543 | Hole: hFc(N297A)-[VPLSLY]-hCD122 | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPSRDELTKNQVSLSCAVK GFYPSDIAVEWESNGQPENNYKTTP PVLDSDGSFFLYSKLTVDKSRWQQG MVFSCSVMHEALHNHYTQKSLSLSP G (SEQ ID NO: 9) | GPPSG SSPG (SEQ ID NO: 36) | VPLSLY (SEQ ID NO: 28) |
| AK502 | DNA577 | Knob: hFc(N297A, I253A)-hIL2 (R38A, F42A, Y45A, E62A, C125A) | DKTHTCPPCPAPQLLGGPSVFLFPP KPKDTLMASRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPEN | GSSPPGGGSSGG GSGP (SEQ ID NO: 23) | APTSSSTKKTQLQLEHLLLDLQMIL NGINNYKNPKLTAMLTAKFAMPKKA TELKHLQCLEEALKPLEEVLNLAQS KNFHLRPRDLISNINIVLELKGSE TTFMCEYADETATIVEFLNRWITFA QSIISTLT (SEQ ID |

| | | -continued | | |
|---|---|---|---|---|
| | | | | NO: 3) |
| AK503 | DNA255 | NIYKTTPPVLDSDGSFFIYSKLTVD KSRWQQGNVFSCSVMHEALHNHYTQ KSLSLSPG (SEQ ID NO: 13) | | |
| AK503 | | Knob: hFc(N297A)- hIL2 (R38A, F42A, Y45A, E62A, C125A) | DKTHTCPPCPAPELLGGPSVFLFPP KPDTLMISRTPEVTCVVVDSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSSPPGGGSSGG GSGP (SEQ ID NO: 23) | APTSSSTKKTQLQLEHLLLDLQMIL NGINNYKNPKLTAMLTAKFAMPKKA TELKHLQCLEEALKPLEEVLNLAQS KNFHLRPRDLISNINIVLELKGSE TTFMCEYADETATIVEFLNRWITFA QSIISTLT (SEQ ID NO: 3) |
| AK503 | DNA606 | Knob: hFc(N297A)- [RAAAVKSP]- hCD122 | DKTHTCPPCPAPELLGGPSVFLFPP KPDTLMISRTPEVTCVVVDSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLVSKLTVDKSRWQQG MVFSCSVMHEALHNHYTQKSLSLSP G (SEQ ID NO: 9) | GPPSGSSP (SEQ ID NO: 37) | RAAAVKSP (SEQ ID NO: 27) |
| AK504 | DNA603 | Hole: hFcIgG4- hCD122 | ESKYGPPCPPCPAPEFLGGPSVFLF PPKPKDTLMISRTPEVTCVVVDVSQ EDPEVQFNWYVDGVEVHNAKTKPRE EQFNSTYRVVSVLTVLHQDWLNGKE YKCKVSNKGLPSSIEKTISKAKGQP REPQVCTLPPSQEMTKNQVSLSCA VKGFYPSDIAVEWESNGQPENNYKT TPPVLDSDGSFFLYSRLTVDKSRWQ EGNVFSCSVMHEALHNHYTQKSLSL SLG (SEQ ID NO: 295) | PGSGS (SEQ ID NO: 14) | AVNGTSQFTCFYNSRANISCVWSQD GALQDTSCQVHAWPDRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK504 | DNA605 | Knob: hFc(N297A)- [VPLSLY]- hIL2 | ESKYGPPCPPCPAPEFLGGPSVFLF PPKPKDTLMISRTPEVTCVVVDVSQ EDPEVQFNWYVDGVEVHNAKTKPRE EQFNSTYRVVSVLTVLHQDWLNGKE | GSPG (SEQ ID NO: 34) | VPLSLY (SEQ ID NO: 28) |

| | | | |
|---|---|---|---|
| AK505 | (R38A, F42A, Y45A, E62A, C125A) | YKCKVSNKGLPSSIEKTISKAKGQP REPQVYTLPPSQEEMTKNQVSLSWC LVKGFYPSDIAVEWESNGQPENNYK TTPPVLDSDGSFFLYSRLTVDKSRW QEGNVFSCSVMHEALHNHYTQKSLS LSLG (SEQ ID NO: 296) | |
| AK505 | DNA603 Hole: hFcIgG4-hCD122 | ESKYGPPCPPCPAPEFLGGPSVFLF PPKPKDTLMISRTPEVTCVVVDSQ EDPEVQFNWYVDGVEVHNAKTKPRE EQFNSTYRVVSVLTVLHQDWLNGKE YKCKVSNKGLPSSIEKTISKAKGQP REPQVCTLPPSQEEMTKNQVSLSCA VKGFYPSDIAVEWESNGQPENNYKT TPPVLDSDGSFFLYSRLTVDKSRWQ EGNVFSCSVMHEALHNHYTQKSLSL SLG (SEQ ID NO: 295) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |
| AK505 | DNA604 Knob: IgG4 hFc-hIL2 (R38A, F42A, Y45A, E62A, C125A) | ESKYGPPCPPCPAPEFLGGPSVFLF PPKPKDTLMISRTPEVTCVVVDSQ EDPEVQFNWYVDGVEVHNAKTKPRE EQFNSTYRVVSVLTVLHQDWLNGKE YKCKVSNKGLPSSIEKTISKAKGQP REPQVYTLPPSQEEMTKNQVSLSWC LVKGFYPSDIAVEWESNGQPENNYK TTPPVLDSDGSFFLYSRLTVDKSRW QEGNVFSCSVMHEALHNHYTQKSLS LSLG (SEQ ID NO: 296) | GSSPPGGSSGG GSGP (SEQ ID NO: 23) APTSSSTKKTQLQLEHLLLDLQMIL NGINNYKNPKLTAMLTAKFAMPKKA TELKHLQCLEEALKPLEEVLNLAQS KNFHLRPRDLISNINIVLELKGSE TTFMCEYADETATIVEFLNRWITFA QSIISTLT (SEQ ID NO: 3) |
| AK508 | DNA577 Knob: hFc (N297A, I253A)-hIL2 (R38A, F42A, Y45A, E62A, C125A) | DKTHTCPPCPAPQLLGGPSVFLFPP KPKDTLMASRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCIVK GFYPSDIAVEWESNGQPEN NIYKTTPPVLDSDGSFFIYSKLTVD KSRWQQGNVFSCSVMHEALHNHYTQ KSLSLSPG (SEQ ID NO: 13) | GSSPPG GGSSGG GSGP (SEQ ID NO: 23) APTSSSTKKTQLQLEHLLLDLQMIL NGINNYKNPKLTAMLTAKFAMPKKA TELKHLQCLEEALKPLEEVLNLAQS KNFHLRPRDLISNINIVLELKGSE TTFMCEYADETATIVEFLNRWITFA QSIISTLT (SEQ ID NO: 3) |

| | | | -continued | |
|---|---|---|---|---|
| AK508 | DNA609 | Hole: hFc(N297A, [VPLSLY]-I253A)-hCD122 | DKTHTCPPCPAPELLGGPSVFLFPP KPKDTLMASRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLVSKLTVDKSRWQQG NVFSCSVMHEALHNHYTQKSLSLSP G (SEQ ID NO: 10) | GPPSG SSPG (SEQ ID NO: 36) | VPLSLY (SEQ ID NO: 28) |
| AK509 | DNA575 | Hole: hFc(N297A, I253A)-hCD122 | DKTHTCPPCPAPELLGGPSVFLFPP KPKDTLMASRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLVSKLTVDKSRWQQG NVFSCSVMHEALHNHYTQKSLSLSP G (SEQ ID NO: 10) | PGSGS (SEQ ID NO: 14) | AVNGTSQFTCFYNSRANISCVWSQD GALQDTSCQVHAWPDRRRWNQTCEL LFVSQASWACNLILGAPDSQKLTTV DIVTLRVLCREGVRWRVMAIQDFKP FENLRLMAPISLQVVHVETHRCNIS WEISQASHYFERHLEPEARTLSPGH TWEEAPLLTLKQKQEWICLETLTPD TQYEFQVRVKPLQGEFTTWSPWSQP LAFRTKPAALGKD (SEQ ID NO: 4) |
| AK509 | DNA623 | Knob: hFc(N297A, I253A)-[MPYDLYHP]-hIL2 (R38A, F42A, Y45A, E62A, C125A) | DKTHTCPPCPAPQLLGGPSVFLFPP KPKDTLMASRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPEN NIYKTTPPVLDSDGSFFIYSKLTVD KSRWQQGNVFSCSVMHEALHNHYTQ KSLSLSPG (SEQ ID NO: 13) | GGSSPP (SEQ ID NO: 32) | MPYDLYHP (SEQ ID NO: 24) |
| AK510 | DNA577 | Knob: hFc(N297A, I253A)-hIL2 | DKTHTCPPCPAPQLLGGPSVFLFPP KPKDTLMASRTPEVTCVVVDVSHED PEVKFNWYVDGVEVHNAKTKPREEQ YASTYRVVSVLTVLHQDWLNGKEYK | GSSPPG GGSSGG GSGP (SEQ ID | APTSSSTKKTQLQLEHLLLLDLQMIL NGINNYKNPKLTAMLTAKFAMPKKA TELKHLQCLEEALKPLEEVLNLAQS KNFHLRPRDLISNINIVLELKGSE |

| | | | |
|---|---|---|---|
| AK510 | (R38A, F42A, Y45A, E62A, C125A) | CKVSNKALPAPIEKTISKAKGQPRE PQVYTLPPCRDELTKNQVSLWCLVK GFYPSDIAVEWESNGQPEN NIYKTTPPVLDSDGSFFIYSKLTVD KSRWQQGNVFSCSVMHEALHNHYTQ KSLSLSPG (SEQ ID NO: 13) | NO: 23) TTFMCEYADETATIVEFLNRWITFA QSIISTLT (SEQ ID NO: 3) |
| AK510 | DNA608 Hole: hFc (N297A, I253A)- [MPYDLYHP]- hCD122 | DKTHTCPPCPAPELLGGPSVFLFPP KPKDTLMASRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLVSKLTVDKSRWQQG NVFSCSVMHEALHNHYTQKSLSLSP G (SEQ ID NO: 10) | MPYDLYHP (SEQ ID NO: 24) |
| AK511 | DNA604 Knob: IgG4 hFc- hIL2 (R38A, F42A, Y45A, E62A, C125A) | ESKYGPPCPPCPAPEFLGGPSVFLF PPKPKDTLMISRTPEVTCVVVDVSQ EDPEVQFNWYVDGVEVHNAKTKPRE EQFNSTYRVVSVLTVLHQDWLNGKE YKCKVSNKGLPSSIEKTISKAKGQP REPQVYTLPPSQEEMTKNQVSLSWC LVKGFYPSDIAVEWESNGQPENNYK TTPPVLDSDGSFFLYSRLTVDKSRW QEGNVFSCSVMHEALHNHYTQKSLS LSLG (SEQ ID NO: 296) | GSSPPG GGSSGG GSGP (SEQ ID NO: 23) APTSSSTKKTQLQLEHLLLDLQMIL NGINNYKNPKLTAMLTAKFAMPKKA TELKHLQCLEEALKPLEEVLNLAQS KNFHLRPRDLISNINIVLELKGSE TTFMCEYADETATIVEFLNRWITFA QSIISTLT (SEQ ID NO: 3) |
| AK511 | DNA621 Hole: hFcIgG4 [VPLSLy]- hCD122 | ESKYGPPCPPCPAPEFLGQPSVFLF PPKPKDTLMISRTPEVTCVVVDVSQ EDPEVQFNWYVDGVEVHNAKTKPRE EQFNSTYRVVSVLTVLHQDVVLNGK EYKCKVSNKGLPSSIEKTISKAKGQ PREPQVCTLPPSQEEMTKNQVSLSC AVKGFYPSDIAVEWESNGQPENNYK TTPPVLDSDGSFFLYSRLTVDKSRW QEGNVFSCSVMHEALHNHYTQKSLS ISLGGP (SEQ ID NO: 297) | PSGSSPG (SEQ ID NO: 313) VPLSLY (SEQ ID NO: 28) |

| | | | |
|---|---|---|---|
| AK512 | DNA577 | Knob: hFc(N297A, I253A)- hIL2 (R38A, F42A, Y45A, E62A, C125A) | DKTHTCPPCPAPQLLGGPSVFLFPP KPKDTLMASRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPEN NIYKTTPPVLDSDGSFFIYSKLTVD KSRWQQGNVFSCSVMHEALHNHYTQ KSLSLSPG (SEQ ID NO: 13) | GSSPPG GGSSGG GSGP (SEQ ID NO: 23) | APTSSSTKKTQLQLEHLLLDLQMIL NGINNYKNPKLTAMLTAKFAMPKKA TELKHLQCLEEALKPLEEVLNLAQS KNFHLRPRDLISNINVIVLELKGSE TTFMCEYADETATIVEFLNRWITFA QSIISTLT (SEQ ID NO: 3) |
| AK512 | DNA625 | Hole: hFc(N297A, I253A) | DKTHTCPPCPAPELLGGPSVFLFPP KPKDTLMASRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLVSKLTVDKSRWQQG NVFSCSVMHEALHNHYTQKSLSLSP G (SEQ ID NO: 10) | | |
| AK513 | DNA604 | Knob: IgG4 hFc- hIL2 (R38A, F42A, Y45A, E62A, C125A) | ESKYGPPCPPCPAPEFLGGPSVFLF PPKPKDTLMISRTPEVTCVVVDVSQ EDPEVQFNWYVDGVEVHNAKTKPRE EQFNSTYRVVSVLTVLHQDWLNGKE YKCKVSNKGLPSSIEKTISKAKGQP REPQVYTLPPSQEEMTKNQVSLSWC LVKGFYPSDIAVEWESNGQPENNYK TTPPVLDSDGSFFLYSRLTVDKSRW QEGNVFSCSVMHEALHNHYTQKSLS LSLG (SEQ ID NO: 296) | GSSPPGG GSSSGG GSGP (SEQ ID NO: 23) | APTSSSTKKTQLQLEHLLLDLQMIL NGINNYKNPKLTAMLTAKFAMPKKA TELKHLQCLEEALKPLEEVLNLAQS KNFHLRPRDLISNINVIVLELKGSE TTFMCEYADETATIVEFLNRWITFA QSIISTLT (SEQ ID NO: 3) |
| AK513 | DNA626 | Hole: hFcIgG4 | ESKYGPPCPPCPAPEFLGGPSVFLF PPKPKDTLMISRTPEVTCVVVDVSQ EDPEVQFNWYVDGVEVHNAKTKPRE EQFNSTYRVVSVLTVLHQDVWLNGK EYKCKVSNKGLPSSIEKTISKAKGQ PREPQVCTLPPSQEEMTKNQVSLSC | | |

| | | | |
|---|---|---|---|
| AK526 | DNA670 | Knob: hFc-hIL2 (R38A, F42A, Y45A, E62A, C125A) | DKTHTCPPCPAPELLGGPSVFLFPP KPKDTLMISRTPEVTCVVVDVSHED PEVKFNWYVDGVEVHNAKTKPREEQ YNSTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 11) | GSSPPG GGSSGG GSGP (SEQ ID NO: 23) | APTSSSTKKTQLQLEHLLLDLQMIL NGINNYKNPKLTAMLTAKFAMPKKA TELKHLQCLEEALKPLEEVLNLAQS KNFHLRPRDLISNINIVLELKGSE TTFMCEYADETATIVEFLNRWITFA QSIISTLT (SEQ ID NO: 3) |
| AK526 | DNA672 | Hole: hFc-[VPLSLY]-hCD122 | DKTHTCPPCPAPELLGGPSVFLFPP KPKDTLMISRTPEVTCVVVDVSHED PEVKFNWYVDGVEVHNAKTKPREEQ YNSTYRVVSVLMLHQDWLNGKEYKC KVSNKALPAPIEHISKAKGQPREPQ VCTLPPSRDELTKNQVSLSCAVKGF YPSDIAVEWESNGQPENNYKTTPPV LDSDGSFFLVSKLTVDKSRWQQGNV FSCCSVMHEALHNHYTQKSLSLSPG (SEQ ID NO: 8) | GPPSGSSPG (SEQ ID NO: 36) | VPLSLY (SEQ ID NO: 28) |
| AK530 | DNA25 | Knob: hFc(N297A, hIL2 (R38A, F42A, Y45A, E62A, C125A) | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | GSSPPGG GSSGG GSGP (SEQ ID NO: 23) | APTSSSTKKTQLQLEHLLLDLQMIL NGINNYKNPKLTAMLTAKFAMPKKA TELKHLQCLEEALKPLEEVLNLAQS KNFHLRPRDLISNINIVLELKGSE TTFMCEYADETATIVEFLNRWITFA QSIISTLT (SEQ ID NO: 3) |
| AK530 | DNA612 | Hole: hFc(N297A, I253A)-[MPYDLYHP]- | DKTHTCPPCPAPELLGGPSVFLFPP KPKDTLMISRTPEVTCVVVDVSHED PEVKFNWYVDGVEVHNAKTKPREEQ YASTYRVVSVLTVLHQDWLNGKEYK | GPPSGSSP (SEQ ID NO: 9) | MPYDLYHP (SEQ ID NO: 24) |

-continued

| | | | |
|---|---|---|---|
| AK531 | hCD122 (C122S, C168S) | CKVSNKALPAPIEKTISKAKGQPRE PQVCTLPPSRDELTKNQVSLSCAVK GFYPSDIAV EWESNGQPENNYKTTPPVLDSDGSF FLVSKLTVDKSRWQQGNVFSCSVMH EALHNHYTQKSLSLSPG (SEQ ID NO: 3) | |
| AK531 | Knob: hFc(N297A)* hIL2 (R38A, Y45A, C125A) | DKTHTCPPCPAPELLGGPSVFLFPP KPKDTLMISRTPEVTCVVVDSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 12) | APTSSSTKKTQLQLEHLLLDLQMIL MGINNYKNPKLTAMLTAKFAMPKKA TELKHLQCLEEALKPLEEVLNLAQS KNFHLRPRDLISNINIVLELKGSE TTFMCEYADETATIVEFLNRWITFA QSIISTLT (SEQ ID NO: 3) |
| AK531 | DNA255 Hole: hFc(N297A)- [DSGGFMLT]- hCD122 (C122S, C168S) | DKTHTCPPCPAPELLGGPSVFLFPP KPKDTLMISRTPEVTCVVVDSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPFNNYKTTP PVLDSDGSFFLVSKLTVDKSRWQQG NVFSCSVMHEALHNHYTQKSLSLSP G (SEQ ID NO: 9) | GSSPP GGGS SGGGSGP (SEQ ID NO: 23) DSGGFMLT (SEQ ID NO: 25) GPPSG SSPG (SEQ ID NO: 36) |
| AK532 | DNA614 DNA669 Hole: hFc-hCD122 | DKTHTCPPCPAPELLGGPSVFLFPP KPKDTLMISRTPEVTCVVVDSHED PEVKFNWYVDGVEVHNAKTKPREEQ YNSTYRVVSVLTVLHQDWLNGKEYK CKVSNKALPAPIEKTISKAKGQPRE PQVCTLPPSRDELTKNQVSLSCAVK GEYPSDIAVEWESNGQPENNYKTCP PVLDSDGSFFLVSKLTVDKSRWQQG MVFSCSVMHEALHNHYTQKSLSLSP G (SEQ ID NO: 8) | PGSGS (SEQ ID NO: 14) AVMGTSQFTCFYNSRANISCVWSQD GALQDTSCQVHAWPDRRRWNQTCEL LPVSQASWACNLILGAPDSQKLTTV DIVTLRVLCREGVRWRVMAIQDFKP FENLRLMAPISLQVHVETHRCNIS WEISQASHYFERHLEFEARTLSPGH TWEEAPLLTLKQKQEWICLETLTPD TQYEFQVRVKPLQGEFTTWSPWSQP LAFRTKPAALGKD (SEQ ID NO: 4) |

-continued

| Molecule | name | newnames | Component4 Sequence | Component5 Sequence | FullSequence |
|---|---|---|---|---|---|
| AK532 | DNA671 | Knob: hFc-[VPLSLY]-hIL2 (R38A, F42A, Y45A, E62A, C125A) | DKTHTCPPCPAPELLGGPSVFLFPP KPKDTLMISRTPEVTCVVVDVSHED PEVKFNWYVDGVEVHNAKTKPREEQ YNSTYRVVSVLTVLHQDWLNGKEYK CKVSNKALPAPIEKTISKAKGQPRE PQVYTLPPCRDTLTKNQVSLWCIVK GFYPSDIAVEWE SNGQPENNYKTPPVLDSDGSFFLY SKLTVDKSRWQQGNVFSCSVMHEAL HNHYTQKSLSLSPG (SEQ ID NO: 11) | GSPG (SEQ ID NO: 34) | VPLSLY (SEQ ID NO: 28) |

| Molecule | name | newnames | Component4 Sequence | Component5 Sequence | FullSequence |
|---|---|---|---|---|---|
| AK368 | DNA187 | Hole: hFc(N297A)-hCD122 | | | DKTHTCPPCPAPELLGGPSVFLPPKPKDTLMISRTPEVT CVVVDVSHEDPEVKFNWYVDGVEVHNAKTKPREEQYASTY RVVSVLTVLHQDWLKGKEYKCKVSNKALPAPIEKTISKAK GQPREPQVCTLPPSRDELTKNQVSLSCAVKGFYPSDIAVE WESNGQPENNYKTPPVLDSDGSFFLVSKLTVDKSRWQQG NVFSCSVMHEALHNHYTQKSLSLSPG (SEQ ID NO: 38) |
| AK368 | DNA476 | Knob: hFc(N297A)-[NPMGSDP VNFKLLRW NG]-hIL2 (F42S, E62S, C1213A) | GP | APTSSSTKKTQLQLEHLLLDLQMI LNGINNYKNPKLTRMLTSKFYMPK KATELKHLQCLEESLKPLEEVLNL AQSKNFHLRPRDLISNINIVLVLEL KGSETTFMCEYADETATIVEFLNR WITFAQSIISTLT (SEQ ID NO: 74) | DKTHTCPPCPAPELLGGPSVFLPPKPKDTLMISRTPEVT CVVVDVSHEDPEVKFNWYVDGVEVHNAKTKPREEQYASTY RVVSVLTVLHQDWLNGKEYKCKVSNKALPAPIEKTISKAK GQPREPQVVT1PPCRDELTKNQVSLWCLVKGFYPSDIAVE WESNGQPENNYKTPPVLDSDGSFFLYSKLTVDKSRWQQG NVFSCSVMHEALHNHYTQKSLSLSPG (SEQ ID NO: 360) |
| AK375 | DNA477 | Knob: mFcIgG2a (LALAPG)-hIL2(R38A, F42A, Y45A, E62A, C125A) | | | TIKPCPPCKCPAPNAAGGPSVFIFPPKIKDVLMISLSPIV TCVVVDVSEDDPDVQISWEFNNVEVHTAQTQTHREDYNST LRVVSALPIQHQDWMSGKEFKCKVNNKDLGAPIERTISKP KGSVRAPQVYVLPPCEEEMTKKQVTLWCMVTDFMPEDIYV EWTNNGKTELNYKNTEPVLDSDGSYFMYSKLRVEKKNWVE RNSYSCSVVHEGLHNHHTTKSFSRTPGGGSSPGGSSSGG GSGPAPTSSSTKKTQLQLEHLLLDLQMILNGINNYKNPKL TAMLTAKEAMPKKATELKHLQCLEEALKPLEEVLNLAQSK NFHLRPRDLISNINIVLELKGSETTFMCEYADETATIVE FLNRWITFAQSIISTLT (SEQ ID NO: 361) |
| AK375 | DNA479 | Hole: mFcIgG2a (LALAPG) | | | TIKPCPPCKCPAPNAAGGPSVFIFPPKIKDVLMISLSPIV TCVVVDVSEDDPDVQISWFVNNVEVHTAQTQTHREDYNST LRVVSALPIQHQDWMSGKEFKCKVNNKDLGAPIERTISKP KGSVRAPQVCVLPPPEEEMTKKQVTLSCAVTDFMPEDIYV EWTNNGKTELNYKNTEPVLDSDGSYFMVSKLRVEKKNWVE RNSYSCVVHEGLHNHTTKSFSRTPG (SEQ ID NO: 281) |

| | | -continued | |
|---|---|---|---|
| AK376 | DNA478 | Knob: mFcIgG2a (LALAPG)-[VPLSLY]-hIL2 (R38A, F42A, Y45A, E62A, C125A) | TIKPCPPCKCPAPNAAGGPSVFIFPPPKIKDVLMISLSP IVTCVVVDVSEDDPDVQISWFVNNVEVHTAQTQTHRED YNSTLRVVSALPIQHQDWMSGKEFKCKVNNKDLGAPIE RTISKPKGSVRAPQVYVLPPCEEEMTKKQVTLWCMVTD FMPEDIYVEWTNNGKTELNYKNTEPVLDSDGSYFMYSK LRVEKKNWVERNSYSCSLLHEGLHNHHTTKSFSRTPGG SPGVPLSLYSGPAPTSSSTKKTQLQLEHLLDLQMIL NGINNYKNPKLTAMLTAKFAMPKKATELKHLQCLEEA LKPLEEVLNLAQSKNFHLRPRDLISNINIVLELKGS ETTFMCEYADETATIVEFLNRWITFAQSIISTLT (SRQ ID NO: 362) |
| AK376 | DNA479 | Hole: mFcIgG2a (LALAPG) | APTSSSTKKTQL QLEHLLDLQMI LNGINNYKNPKL TAMLTAKFAMP KKATELKHLQCL EEALKPLEEVLN LAQSKNFHLRPR DLISNINIVLEL KGSETTFMCEY ADETATIVEFLN RWITFAQSIISTL T (SEQ ID NO: 3) | TIKPCPPCKCPAPNAAGGPSVFIFPPPKIKDVLMISLSPIV TCVVVDVSEDDPDVQISWFVNNVEVHTAQTQTHREDYNST LRVVSALPIQHQDWMSGKEFKCKVNNKDLGAPIERTISKP KGSVRAPQVCVLPPEEEMTKKQVTLSCAVTDFMPEDIYV EWTNNGKTELNYKNTEPVLDSDGSYFMVSKLRVEKKNWVE RNSYSCVVHEGLHNHHTTKSFSRTPG (SEQ ID NO: 281) |
| AK377 | DNA477 | Knob: mFcIgG2a (LALAPG)-hIL2 (R38A, F42A, Y45A, E62A, C125A) | | TIKPCPPCKCPAPNAAGGPSVFIFPPPKIKDVLMISLSPIV TCVVVDVSEDDPDVQISWEFNNVEVHTAQTQTHREDYNST LRVVSALPIQHQDWMSGKEFKCKVNNKDLGAPIERTISKP KGSVRAPQVYVLPPCEEEMTKKQVTLWCMVTDFMPEDIYV EWTNNGKTELNYKNTEPVLDSDGSYFMYSKLRVEKKNWVE RNSYSCSVVHEGLHNHHTTKSFSRTPGGGSSGGSSGG GSGPAPTSSSTKKTQLQLEHLLDLQMILNGINNYKNPKL TAMLTAKEAMPKKATELKHLQCLEEALKPLEEVLNLAQSK NFHLRPRDLISNINIVLELKGSETTFMCEYADETATIVE FLNRWITFAQSIISTLT (SEQ ID NO: 361) |
| AK377 | DNA480 | Hole: mFcIgG2a (LALAPG)-hCD122 | | TIKPCPPCKCPAPNAAGGPSVFIFPPPKIIKDV LMISLSPIVTCVVVDVSEDDPDVQISWFVN NVEVHTAQTQTHREDYNSTLRVVSALPIQH QDWMSGKEFKCKVNNKDLGAPIERTISKPK GSVRAPQVCVLPPEEEMTKKQVTLSCAVT DFMPEDIYVEWTNNGCTELNYKNTEPVLDS DGSYFMVSKLRVEKKNWVERNSYSCSWHEG LKNHHTTKSFSRTPGPGSGSAVNGTSQFTC FYNSRANISCVVVSQDGALQDTSCQVHAWP DRRRMNQTCELLPVSQASWACNLILGAPDS QKLTTVDIVTLRVLCREGVRWRVMAIQDFK PFENLRLMAPISLQVVHVETHRCNISWEISQ ASHYFERHLEFEARTLSPGHTWEEAPLLTL KQKQEWICLETLTPDTQYEFQVRVKPLQGE FTTWSPVVSQPLAFRTKPAALGKD (SEQ ID NO: 363) |

| | | | |
|---|---|---|---|
| AK378 | DNA478 | Knob:<br>mFcIgG2a<br>(LALAPG)-<br>[VPLSLY]-<br>hIL2<br>(R38A,<br>F42A,<br>Y45A,<br>E62A,<br>C125A) | SGP<br>(SEQ ID<br>NO: 29) | APTSSSTKKTQL<br>QLEHLLLDLQMI<br>LNGINNYKNPKL<br>TAMLTAKFAMP<br>KKATELKHLQCL<br>EEALKPLEEVLN<br>LAQSKNFHLRPR<br>DLISNINVIVLEL<br>KGSETTFMCEY<br>ADETATIVEFLN<br>RWITFAQSIISTL<br>T<br>(SEQ ID<br>NO: 3) | TIKPCPPCKCPAPNAAGGPSVFIFPPKIKDVLMISLSP<br>IVTCVVVDVSEDDPDVQISWFVNNVEVHTAQTQTHRED<br>YNSTLRVVSALPIQHQDWMSGKEFKCKVNNKDLGAPIE<br>RTISKPKGSVRAPQVYVLPPCEEEMTKKQVTLWCMVTD<br>FMPEDIYVEWTNNGKTELNYKNTEPVLDSDGSYFMYSK<br>LRVEKKNWVERNSYSCSLLHEGLHNHHTTKSFSRTPGG<br>SPGVPLSLYSGPATSSSTKKTQLQLEHLLLDLQMIL<br>NGINNYKNPKLTAMLTAKFAMPKKATELKHLQCLEEA<br>LKPLEEVLNLAQSKNFHLRPRDLISNINVIVLELKGS<br>ETTFMCEYADETATIVEFLNRWITFAQSIISTLT<br>(SEQ ID NO: 362) |
| AK378 | DNA480 | Hole:<br>mFcIgG2a<br>(LALAPG)-<br>hCD122 | | | TIKPCPPCKCPAPNAAGGPSVFIFPPKIKDV<br>LMISLSPIVTCVVVDVSEDDPDVQISWFVN<br>NVEVHTAQTQTHREDYNSTLRVVSALPIQH<br>QDWMSGKEFKCKVNNKDLGAPIERTISKPK<br>GSVRAPQVCVLPPEEEMTKKQVTLSCAVT<br>DFMPEDIYVEWTNNGCTELNYKNTEPVLDS<br>DGSYFMVSKLRVEKKNWVERNSYSCSWHEG<br>LKNHHTTKSFSRTPGPGSGSAVNGTSQFTC<br>FYNSRANISCVVVSQDGALQDTSCQVHAWP<br>DRRRWNQTCELLPVSQASWACNLILGAPDS<br>QKLTTVDIVTLRVLCREGVRWRVMAIQDFK<br>PFENLRLMAPISLQVVHVETHRCNISWEISQ<br>ASHYFERHLEFEARTLSPGHTWEEAPLLTL<br>KQKQEWICLETLTPDTQYEFQVRVKPLQGE<br>FTTWSPVVSQPLAFRTKPAALGKD<br>(SEQ ID NO: 363) |
| AK397 | DNA158 | Hole:<br>hFc<br>(N297A) | | | DKTHTCPPCPAPELLGGPSVFLFPPKPKDTL<br>MISRTPEVTCVVVDVSHEDPEVKFNWYVDGV<br>EVHNAKTKPREEQYASTYRVVSVLTVLHQDW<br>LNGKEYKCKVSNKALPAPIEKTISKAKGQPR<br>EPQVCTLPPSRDELTKNQVSLSCAVKGFYPS<br>DIAVEWESNGQPENNYKTTPPVLDSDGSFFL<br>VSKLTVDKSRWQQGMVFSCSVMHEALHNHY<br>TQKSLSLSPG<br>(SEQ ID NO: 9) |
| AK397 | DNA278 | Knob:<br>hFc(N297A)-<br>[DSGGFMLT]<br>hIL2<br>(C125A) | SGP<br>(SEQ ID<br>NO: 29) | APTSSSTKKTQL<br>QLEHLLLDLQMI<br>LNGINNYKNPKL<br>TRMLTKFYMP<br>KKATEIKHIQCL<br>EEELKPLEEVLN<br>LAQSKNFHLRPR<br>DLISNINVTVLEL | DKTHTCPPCPAPELIGGPSVFLFPPKPDTLMIS<br>RTPEVTCVVVDVSHEDPEVKFNWYVDGVEVHNAK<br>TKPREEQYASTYRVVSVLTVLHQDMLNGKEYKCK<br>VSNKALPAPIEKTISKAKGQPREPQVYTLPPCRD<br>ELTKNQVSLWCLVKGFYPSDIAVEWESNGQPENN<br>YKTTPPVLDSDGSFFLYSKLTVDKSRWQQGNVFS<br>CSVMHEALHNHYTQKSLSLSPGSGPDSGGFMLT<br>SGPAPTSSSTKKTQLQLEHLILDLQMILNGINNY |

| AK429 | DNA477 | Knob: mFcIgG2a (LALAPG)-hIL2(R38A, F42A, Y45A, E62A, C125A) | KGSETTFMCEY ADETATIVEFLN RWITFAQSIISTL T (SEQ ID NO: 62) | KNPKLTRMLTFKFYMPKKATELKHLQCLEEELKP LEEVLNLAQSKNFHLRPDLISNINVIVLELKGS ETTFMCEYADETATIVEFLNRWITFAQSIISTL T (SEQ ID NO: 357) TIKPCPPCKCPAPNAAGGPSVFIFPPKIKD VLMISLSPIVTCVVVDVSEDDPDVQISWFV NNVEVHTAQTQTHREDYNSTLRVVSALPIQ HQDWMSGKEFKCKVNNKDLGAPIERTISKP KGSVRAPQVYVLPPCEEEMTKKQVTLWCMV TDFMPEDIYVEWTNNGKTELYKNTEPVLDS DGSYFMYSKLRVEKKNWVERNSYSCCSVVHE GLHNHHTTKSFSRTPGGGSSPPGGGSSGGG SGPAPTSSSTKKTQLQLEHLLLDLQMILNG INNYKNPKLTAMLTAKFAMPKKATELKHLQ CLEEALKPLEEVLNLAQSKNFHLRPRDLIS NINIVLELKGSETTFMCEYADETATIVEF LNRWITFAQSIISTLIT (SEQ ID NO: 361) |
|---|---|---|---|---|
| AK429 | DNA520 | Hole: mFcIgG2a (LALAPG)- No Annotation Found | | TIKPCPPCKCPAPNAAGGPSVFIFPPKIKDV LMLSLSPVTCVVVDVSEDDPDVQISWFVN NVEVHTAQTQTHREDYNSTLRVVSALPIQH QDVVMSGKEFKCKVNNKDLGAPIERTISKP KGSVRAPQVCVLPPEEEMTKKQVTLSCAV TDFMPEDIYVEWTNNGKTELNYKMTEPVLD SDGSYFMVSKLRVEKKNWVERNSYSCSVVH EGLHNHHTTKSFSRTPGHHHHHHHH (SEQ ID NO: 365) |
| AK430 | DNA477 | Knob: mFcIgG2a (LALAPG)-hIL2(R38A, F42A, Y45A, E62A, C125A) | | TIKPCPPCKCPAPNAAGGPSVFIFPPKIKD VLMISLSPIVTCVVVDVSEDDPDVQISWFV NNVEVHTAQTQTHREDYNSTLRVVSALPIQ HQDWMSGKEFKCKVNNKDLGAPIERTISKP KGSVRAPQVYVLPPCEEEMTKKQVTLWCMV TDFMPEDIYVEWTNNGKTELYKNTEPVLDS DGSYFMYSKLRVEKKNWVERNSYSCCSVVHE GLHNHHTTKSFSRTPGGGSSPPGGGSSGGG SGPAPTSSSTKKTQLQLEHLLLDLQMILNG INNYKNPKLTAMLTAKFAMPKKATELKHLQ CLEEALKPLEEVLNLAQSKNFHLRPRDLIS NINIVLELKGSETTFMCEYADETATIVEF LNRWITFAQSIISTLIT (SEQ ID NO: 361) |
| AK430 | DNA521 | Hole: mFcIgG2a (LALAPG)-hCD122 No Annotation Found | GHHH HHHHH (SEQ ID NO: 334) | TIKPCPPCKCPAPNAAGGPSVFIFPPKIKDV LMISISPIVTCVVVDVSEDQPDVQISWFVN NVEVHTAQTQTHREDYNSTLRWSALPIQHQ PWMSGKEFKCKVNNKDLGAPIERTISKPKG SVRAPQVCVLPPPEEEMTKKQVTLSCAVTD FMPEDIYVEWTNNGKTELNYKNTEPVLDSD GSYFMVSKLRVEKKNWVERNSYSCSVVHEG |

| AK431 | DNA477 | | LHNHHTTKSFSRTPGPSGSAVNGTSQFTC<br>FYNSRANISCVWSQDGALQDTSCQVHAWPD<br>RRRMNQTCELLPVSQASVVACNLILGAPDS<br>QKITTVDIVTLRVICREGVRMRVMAIQDFK<br>PFENLRLMAPISLQVVHVETHRCNISW<br>EISQASHYFERHLEFEARTLSPGHTWEEAP<br>ILTLKQKQEWICLETLTPDTQYEFQVRVKP<br>LQGEFTTWSPWSQPLAFRTKPAALGKDGHH<br>HHHHHH<br>(SEQ ID NO: 366) |
|---|---|---|---|
| AK431 | DNA522 | Knob:<br>mFcIgG2a<br>(LALAPG)-<br>hIL2(R38A,<br>F42A,<br>Y45A,<br>E62A,<br>C125A) | TIKPCPPCKCPAPNAAGPSVFIFPPKIKD<br>VLMISLSPIVTCVVVDVSEDDPDVQISWFV<br>NNVEHTAQTQTHREDYNSTLRVVSALPIQ<br>HQDWMSGKEFKCKVNNKDLGAPIERTISKP<br>KGSVRAPQVYVLPPCEEEMTKKQVTLWCMV<br>TDFMPEDIYVEWTNNGKTELYKNTEPVLDS<br>DGSYFMYSKLRVEKKNWVERNSYSCSVHE<br>GLHNHHTTKSFSRTPGGGSSPPGGGSSGGG<br>SGPAPTSSSSTKKTQLQLEHLLLDLQMILNG<br>INNYKNPKLJTAMLTAKFAMPKKATELKHLQ<br>CLEEALKPLEEVLNLAQSKNFHLRPRDLIS<br>NINVIVLELKGSETTFMCEYADETATIVEF<br>LNRWITFAQSIISTLT<br>(SEQ ID NO: 361) |
| AK431 | DNA522 | Knob:<br>mFcIgG2a<br>(LALAPG)-<br>hCD122<br>No<br>Annotation<br>Found | TIKPCPPCKCPAPNAAGGPSVFIFPPKIKDV<br>LMISLSPIVTCVVVDVSEDDPDVQISWFVN<br>NVEVHTAQTQTHREDYNSTLRWSALPIQHQ<br>DWMSGKEFKCKVNNKDLGAPIERTISKPKG<br>SVRAPQVCVLPPPEEEMTKKQVTLSCAVTD<br>FMPEDIYVEWTNNGKTELNYKNTEPVLDSD<br>GSYFMVSKLRVEKKNWVERNSYSCSVVHEG<br>LHNHHTTKSFSRTPGPGSGSAVKNCSHLEC<br>FYNSRANVSCMWSHEEALNVTTCHVHAKSN<br>LRHWNKTCELTLVRQASWACMLILGSFPES<br>QSLTSVDLLDINVVCWEEKGWRRVKTCDFH<br>PFDNLRLVAPHSLQVLHIDTQRCNISWKVS<br>QVSHYIEPYLEFEARRLLGHSWEDASVLS<br>LKQPQQWLFLEMLIPSTSYEVQVRVKAQRN<br>NTGTWSPWSQPLTFRTRPADPMKEGHHHHH<br>HHH (SEQ ID NO: 367) | GHHH<br>HHHHH<br>(SEQ ID<br>NO: 334) |
| AK432 | DNA478 | Knob:<br>mFcIgG2a<br>(LALAPG)-<br>[VPLSLY]<br>hIL2(R38A,<br>F42A,<br>Y45A, | TIKPCPPCKCPAPNAAGGPSVFIFPPKIKDVLMISLSP<br>IVTCVVVDVSEDDPDVQISWFVNNVEVHTAQTQTHRED<br>YNSTLRVVSALPIQHQDWMSGKEFKCKVNNKDLGAPIE<br>RTISKPKGSVRAPQVYVLPPCEEEMTKKQVTLWCMVTD<br>FMPEDIYVEWTNNGKTELNYKNTEPVLDSDGSYFMYSK<br>LRVEKKNWVERNSYSCSLLHEGLHNHHTTKSFSRTPGG<br>SPGVPLSLYSGPAPTSSSSTKKTQLQLEHLLLDLQMIL | APTSSSSTKKTQL<br>QLEHLLLDLQMI<br>LNGINNYKNPKL<br>TAMLTAKFAMP<br>KKATELKHLQCL<br>EERALKPLEEVLN<br>LAQSKNFHLRPR<br>SGP<br>(SEQ ID<br>NO: 29) |

| | | | |
|---|---|---|---|
| | | | DLISNINIVL ELKGSETTFMC EYADETATIVEF LNRWITFAQSII STLT (SEQ ID NO: 3) | NGINNYKNPKLTAMLTAKFAMPKKATELKHLQCLEEA LKPLEEVLNLAQSKNFHLRPRDLISNINIVLELKGS ETTFMCEYADETATIVEFLNRWITFAQSIISTLT (SEQ ID NO: 362) |
| AK432 | DNA521 | Hole: mPcIgG2a (LALAPG)- hCD122 No Annotation Found | GHHH HHHHH (SEQ ID NO: 334) | TIKPCPPCKCPAPNAAGGPSVFIFPPKIKDV LMISISPIVTCVVVDVSEDQPDVQISWFVN NVEVHTAQTQTHREDYNSTLRWSALPIQHQ PWMSGKEFKCKVNNKDLGAPIERTISKPKG SVRAPQVCVLPPPEEEMTKKQVTLSCAVTD FMPEDIYVEWTNNGKTELNYKNTEPVLDSD GSYFMVSKLRVEKKNMVERNSYSCSVVHEG LHNHHTTKSFSRTPGPGSGSAVNGTSQFTC FYNSRANILSCVWSQDGALQDTSCQVHAWPD RRRWNQTCELLPVSQASVVACNLILGAPDS QKITTVDIVTLRVICREGVRWRVMAIQDFK PFENLRLMAPISLQVVHVETHRCNISW EISQASHYFERHLEFEARTLSPGHTWEEAP ILTLKQKQEWICLETLTPDTQYEFQVRVKP LQGFFTTWSPWSQPLAFRTKPAALGKDGHH HHHHH (SEQ ID NO: 366) |
| AK433 | DNA478 | Knob: mPcIgG2a (LALAPG)- hCD122 hIL2(R38A, F42A, Y45A, E62A, C125A) | APTSSSTKKTQL QLEHLLLDLQMI LNGINNYKNPKL TAMLTAKFAMP KKATELKHLQCL EERALKPLEEVLN LAQSKNFHLRPR DLISNINIVL ELKGSETTFMC EYADETATIVEF LNRWITFAQSII STLT (SEQ ID NO: 3) | TIKPCPPCKCPAPNAAGGPSVFIFPPKIKDV IVTCVVVDVSEDDPDVQISWFVNNVEVHTAQTQTHRED YNSTLRVVSALPIQHQDWMSGKEFKCKVNNKDLGAPIE RTISKPKGSVRAPQVYVLPPCEEEMTKKQVTLWCMVTD FMPEDIYVEWTNNGKTELNYKNTEPVLDSDGSYFMYSK LRVEKKNMVERNSYSCSLLHEGLHNHHTTKSFSRTPGG SPGVPLSLYSGPAPTSSSTKKTQLQLEHLLLDLQMIL NGINNYKNPKLTAMLTAKFAMPKKATELKHLQCLEEA LKPLEEVLNLAQSKNFHLRPRDLISNINIVLELKGS ETTFMCEYADETATIVEFLNRWITFAQSIISTLT (SEQ ID NO: 362) |
| AK433 | DNA522 | Knob: mPcIgG2a (LALAPG)- hCD122 No Annotation Found | GHHH HHHHH (SEQ ID NO: 334) | TIKPCPPCKCPAPNAAGGPSVFIFPPKIKDV LMISLSPIVTCVVVDVSEDDPDVQISWFVN NVEVHTAQTQTHREDYNSTLRWSALPIQHQ DWMSGKEFKCKVNNKDLGAPIERTISKPKG SVRAPQVCVLPPPEEEMTKKQVTLSCAVTD FMPEDIYVEWTNNGKTELNYKNTEPVLDSD GSYFMVSKLRVEKKNMVERNSYSCSVVHEG LHNHHTTKSFSRTPGPGSGSAVKNCSHLEC FYNSRANVSCMWSHEEALNVTTCHVHAKSN LRHWNKTCELTLVRQASWACMLILGSFPES QSLTSVDLLDINVCWEEKGWRRVKTCDFH PFDNLRLVAPHSLQVLHIDTQRCNISWKVS |

| | | | |
|---|---|---|---|
| AK435 | DNA263 | Knob:<br>hFc<br>(N297A)-<br>[VPLSLY]<br>hIL2(R38A,<br>F42A,<br>Y45A,<br>E62A,<br>C125A) | SGP<br>(SEQ ID<br>NO: 29) | APTSSSTKKTQL<br>QLEHLLLDLQMI<br>LNGINNYKNPKL<br>TAMLTAKFAMP<br>KKATELKHLQCL<br>EEALKPLEEVLN<br>LAQSKNFHLRPR<br>DLISNINIVL<br>ELKGSETTFMC<br>EYADETATIVEF<br>LNRWITFAQSII<br>STLT<br>(SEQ ID<br>NO: 3) | QVSHYIEPYLEFARRLLGHSWEDASVLS<br>LKQRQQWLFLEMLIPSTSYEVQVRVKAQRN<br>NTGTWSPWSQPLTFRTRPADPMKEGHHHHH<br>HHH (SEQ ID NO: 367)<br>DKTHTCPPCPAPELLGGPSVFLFPPKPKDTL<br>MISRTPEVTCVVVDVSHEDPEVKFNWYVDG<br>VEVHNAKTKPREEQYASTYRVVSVLTVLHQ<br>DWLNGKEYKCKVSNKALPAPIEKTISKAKG<br>QPREPQVYTLPPCRDELTKNQVSLMCLVKG<br>FYPSDIAVEWESMGQPENNYICRRPPVLDS<br>QGSFFLYSKLTVDKSRWQQGNVFSCSVMHE<br>ALHNHYTQKSLSISPGGSPGVPLSLYSGPA<br>PTSSSTKKTQLQIPHLIIQLQMILNGINNY<br>KNPKLTAMLTAKFAMPKKATELKHLQCLEE<br>ALKPLEEVLNLAQSKNFHLRPRDLISNINV<br>IVLELKGSETTFMCEYADETATIVEFLNRW<br>ITFAQSIISTLT (SEQ ID NO: 49) |
| AK435 | DNA516 | F8ScFv<br>Version1-<br>Hole:<br>hFc<br>(N297A)-<br>hCD122 | PGSGS<br>(SEQ ID<br>NO: 14) | AVNGTSQFT<br>CFYNSRANI<br>SCVWSQDGA<br>LQDTSCQVH<br>AWPDRRRWN<br>QTCELLPVS<br>QASWACNL<br>ILGAPDSQK<br>LTTVDIVTL<br>RVLCREGV<br>RWRVM<br>AIQDFKPFE<br>NLRLMAPIS<br>LQVVHVETH<br>RCNI<br>SWEISQASH<br>YFPRHLEFE<br>ARTLSPGHT<br>WEEA<br>PLLTLKQKQ<br>EWICLETLT<br>PDTQYEFQV<br>RVKP<br>LQGEFTTWS<br>PWSQPLAFR<br>TKPAALGKD<br>(SEQ ID<br>NO: 4) | EVQLLESGGGLVQPGGSLRLSCAASGFTFSL<br>FTMSVWRQAPGKGLEWVSAISGSGGSTYYA<br>DSVKGRFTISRDNSKNTLYLQMNSLRAEQT<br>AVYYCAKSTHLYLFDYWGQGTLVTVSSGGG<br>GSGGGGSGGGGSEIVLTQSPGTLSLSPGER<br>ATLSCRASQSVSMPFLAWYQQKPGQAPRLL<br>IYGASSRATGIPDRFSGSGSGTDFTLTISR<br>LEPEDFAVYYCQQMRGRPPTFGQGTKVEIK<br>GGSDKTHTCPPCPAPELLGGPSVFLFPPKP<br>KDTLMISRTPEVTCVVVDVSHEDPEVKFNW<br>YVDGVEVHNAKTKPREEQYASTYRMSVLTV<br>LHQDWLNGKEYKCKVSNKALPAPIEKTISK<br>AKGQPREPQVCTLPPSRDELTKNQVSLSCA<br>VKGFYPSDIAVEWESNGQPENNYKTTPPVL<br>DSDGSFFLVSKLTVDKSRWQQGNVFSCSVM<br>HEALHNHYTQKSLSLSPGPGSGSAVNGTSQ<br>FTCFYNSRANISCVWSQDGALQDTSCQVHA<br>WPDRRRWNNQTCELLPVSQASWACNLILGA<br>PDSQKLTVDIVTLRVLCREGVRWRVMAIQ<br>DFKPFENLRLMAPISLQVVHVETHRCNISW<br>EISQASHYFPRHLEFEARTLSPGHTWEEAP<br>LLTLKQKQEWICLETLTPDTQYEFQVRVKP<br>LQGEFTTWSPWSQPLAFRTKPAALGKD<br>(SEQ ID NO: 364) |
| AK436 | DNA187 | Hole:<br>hFc(N297A)-<br>hCD122 | | | DKTHTCPPCPAPELLGGPSVTLFPPKPKDTL<br>MISRTPEVTCVVVDVSHEDPEVKFNWYVDG<br>VEVHNAKTKPREEQYASTYRVVSVLTVLHQ<br>DWLNGKEYKCKVSNKALPAPIEKTISKAKG |

-continued

| | | |
|---|---|---|
| AK436 | DNA542 | Knob: hFc (N297A)-hIL2 (R38A, F42A, Y45A, E62A, C125A) | QPREPQVCTLPPSRDELTKNQVSLSCAVKG FYPSQIAVEWESNGQPENNYKTTPPVLQSD GSFFLVSKLTVQKSRWQQGNVFSCSVMHEA LHNHYTQKSLSLSPGSGAVNGTSQFTC FYNSRANISCVWSQDGALQDTSCQVHAWPQ RRRMNQTCEILPVSQASWACNLILGAPQSQ KLTTVDIVTLRVLCREGVRWRVMAIQDFKP FENLRLMAPISLQVHVETHRCNISWEISQ ASHYFERHLEFEARTLSPGHTWEEAPLLTL KQKQFWICLETLTPDTQYEFQVRVKPLQGE FTTWSPWSQPLAFRTKPAALGKD (SEQ ID NO: 38) |
| AK437 | DNA187 | Hole: hFc (N297A)-hIL2 (R38A, F42A, Y45A, E62A, C125A) | DKTHTCPPCPAPELLGGPSVFLFPPKPKDTL MISRTPEVTCVVVDVSHEDPEVKFNWYVDG VEVHNAKTKPREEQYASTYRVVSVLTVLHQ DWLNGKEYKCKVSNKALPAPIEKTISKAKG QPREPQVYTLPPCRDELTKNQVSLWCLVKG FYPSDIAVEWESNGQPENNYKTTPPVLDSO GSFFLYSKLTVDKSRWQQGNVFSCSVMHEA LHNHYTQKSLSLSPGISSGLLSGRSQQPS GPAPTSSSTKKTQLQEHLLLQLQMILNGI NNYKNPKLITAMLTAKFAMPKKATELKHLQC LEEALKPLEEVLNLAQSKNFHLRPRDLISN INVIVLELKGSETTFMCEYAQETATIVEFI NRWTFAQSIISTLT (SEQ ID NO: 373) |
| AK437 | DNA187 | Hole: hFc (N297A)-hCD122 | DKTHTCPPCPAPELLGGPSVTLFPPKPKDTL MISRTPEVTCVVVDVSHEDPEVKFNWYVDG VEVHNAKTKPREEQYASTYRVVSVLTVLHQ DWLNGKEYKCKVSNKALPAPIEKTISKAKG QPREPQVCTLPPSRDELTKNQVSLSCAVKG FYPSQIAVEWESNGQPENNYKTTPPVLQSD GSFFLVSKLTVQKSRWQQGNVFSCSVMHEA LHNHYTQKSLSLSPGSGAVNGTSQFTC FYNSRANISCVWSQDGALQDTSCQVHAWPO RRRMNQTCEILPVSQASWACNLILGAPQSQ KLTTVDIVTLRVLCREGVRWRVMAIQDFKP FENLRLMAPISLQVHVETHRCNISWEISQ ASHYFERHLEFEARTLSPGHTWEEAPLLTL KQKQFWICLETLTPDTQYEFQVRVKPLQGE FTTWSPWSQPLAFRTKPAALGKD (SEQ ID NO: 38) |
| AK437 | DNA545 | Knob: hFc (N297A)-hIL2 (R38A, F42A, Y45A, E62A, | DKTHTCPPCPAPELLGGPSVFLFPPKPKDTL MISRTPEVTCVVVDVSHEDPEVKFNWYVDG VEVHNAKTKPREEQYASTYRVVSVLTVLHQ PWLNGKEYKCKVSNKALPAPIEKHSKAKGQ PRGPQVYTIPPCRDELTKNQVSLWCIVKGF YPSDIAVEWESNGQPENNYKTTPPVLDSDG SFFLYSKLTVDKSRWQQGNVFSCSVMHEAL HNHYTQKSLSLSPGISSGLLSGRSSGPAP |

| | | -continued | |
|---|---|---|---|
| AK438 | DNA255 | C125A) | TSSSTKKTQLQLEHLLLDLQMILNGINNYK NPKLTAMLTAKFAMPKKATELKHLQCLEEA LKPLEEVLNLAQSKNFHLRPRDLISNINVI VLELKGSETTFMCEYADETATIVEFLNRWI TFAQSIISTLT (SEQ ID NO: 376) |
| AK438 | DNA255 | Knob:<br>hFc<br>(N297A)-<br>hIL2<br>(R38A,<br>F42A,<br>Y45A,<br>E62A,<br>C125A) | DKTHTCPPCPAPELLGGPSVFLFPPKPKDT LMISRTPEVTCVVVDVSHEDPEVKFNWYVD GVEVHNAKTKPREEQYASTYRVVSVLTVLH QDWLNGKEYKCKVSNKALPAPIEKTISKAK GQPREPQVVTLPPCRDELTKNQVSLWCLVK GFYPSDIAVEWESMGQPENNYKTTPPVLDS DGSFFLYSKLTVDKSRWQQGNVFSCSVMHE ALHNHYTQKSLSLSPGGGSSPPGGGSSGGG SGPAPTSSSTKKTQLQLEHLLLDLQMILNG INNYKNPKLTAMLTAKFAMPKKATELKHLQ CLEEALKPLEEVLNLAQSKNFHLRPRDLISN INVIVLELKGSETTFMCEYADETATIVEFL NRWITFAQSIISTLT<br>(SEQ ID NO: 51) |
| AK438 | DNA543 | Hole:<br>hFc(N297A)-<br>[VPLSLY]<br>HCD122 | DKTHTCPPCPAPELLGGPSVFLFPPKPKDT LMISRTPEVTCVVVDVSHEDPEVKFNWYVD GVEVHNAKTKPREEQYASTYRWSVLTVLHQ DWINGKEYKCKVSNKALPAPIEKTISKAKG QPREPQVCTLPPSRDELTKNQ AVNGTSQFT VSLSCAVKGFYPSDIAVEWESNGQPENNYK CFYNSRANI TTPPVLDSDGSFFLVSKLTVDKSRWQQGNV SCVWSQDGA FSCSVMHEALHNHYTQKSLSLSPGGPPSGS LQDTSCQVH SPGVPLSLYGSGGAVNGTSQFTCFYNSRA AWPDRRRWN NISCVWSQDGALQDTSCQVHAWPDRRRWNQ QTCELLPVS TCELLPVSQASWACNLILGAPDSQKLTTVD QASWACNL IVTLRVLCREGVRWRVMAIQDFKPFENLRL ILGAPDSQK MAPISLQVHVETHRCNISWEISQASHYFER LTTVDIVTL HLEFEARTLSPGHTWEEAPLLTLKQKQEWI RVLCREGV CLETLTPDTQYEFQVRVKPLQGEFTTWSPW RWRVM SQPLAFRTKPAALGKD AIQDFKPFE (SEQ ID NO: 42) NLRLMAPIS LQVHVETH RCNI SWEISQASH YFERHLEFE ARTLSPGHT WEEA PLLTLKQKQ EWICLETLT PDTQYEFQV RVKP LQGEFTTWS PWSQPLAFR TKPAALGKD (SEQ ID NO: 4) |
| AK439 | DNA158 | Hole:<br>hFc(N297A) | DKTHTCPPCPAPELLGGPSVFLFPPKPKDTL MISRTPEVTCVVVDVSHEDPEVKFNWYVDGV EVHNAKTKPREEQYASTYRVVSVLTVLHQDW |

| | | | |
|---|---|---|---|
| AK439 | DNA544 | Knob:<br>hFc(N297A)-<br>[VPLSLY]-<br>hIL2<br>(R38A,<br>F42A,<br>Y45A,<br>E62A,<br>L80F,<br>R81D,<br>L85V,<br>I85V,<br>I92F,<br>C125A) | APTSSSTKKTQL<br>QLEHLLLDLQMI<br>LNGINNYKNPKL<br>TAMLTAKFAMP<br>KKATELKHLQCL<br>EEALKPLEEVLN<br>LAQSKNFHFDP<br>RDWSNIMVFVL<br>SIKGSETTFMCE<br>YADETATIVEFL<br>NRWITFAQSII<br>STIT<br>(SEQ ID<br>NO: 328) | LNGKEYKCKVSNKALPAPIEKTISKAKGQPR<br>EPQVCTLPPSRDELTKNQVSLSCAVKGFYPS<br>DIAVEWESNGQPENNYKTTPVLDSDGSFFL<br>VSKLTVDKSRWQQGMVFSCCSVMHEALHNHY<br>TQKSLSLSPG<br>(SEQ ID NO: 9)<br><br>DKTHTCPPCPAPELLGGPSVFLFPPKPKDT<br>LMISRTPEVTCVVVDVSHEDPEVKFNWYVD<br>GVEVHNAHTKPREEQYASTYRVVSVLTVLH<br>QDWLNGKEYKCKVSNKALPAPIEKTISKAK<br>GQPREPQVVTLPPCRDELTKNQVSLWCLVK<br>GFYPSDIAVEWESNGQPENNYKTTPPVLDS<br>DGSFFLYSKLTVDKSRWQQGNVFSCSVMHE<br>ALHNHYTQKSLSLSPGGSPGVPLSLYSGPA<br>PTSSSTKKTQLQLEHLLLDLQMIINGINNY<br>KNPKLITAMLTAKFAMPKKATELKHLQCLEE<br>ALKPLEEVLNLAQSKNFHFDPRDWSNINVF<br>VLELKGSETTFMCEYADETATIVEFLNRWI<br>TFAQSIISTLT<br>(SEQ ID NO: 375) |
| AK440 | DNA187 | Hole:<br>hFc(N297A)-<br>hCD122 | | DKTHTCPPCPAPELLGGPSVFLFPPKPKDT<br>LMISRTPEVTCVVVDVSHEDPEVKFNWYVD<br>GVEVHNAKTKPREEQYASTYRWSVLTVLHQ<br>DWLNGKEYKCKVSNKALPAPIEKTISKAKG<br>QPREPQVCTLPPSRDELTKNQVSLSCAVKG<br>FYPSDIAVEWESNGQPENNYKTTPPVLDSD<br>GSFFLVSKLTVDKSRWQQGNVFSCSVMHEA<br>LHNHYTQKSLSLSPGP6SGSAVNGTSQFTC<br>FYNSRANISCVWSQDGALQDTSCQVHAMPD<br>RRRMNQTCELLPVSQASWACNLIILGAPDSQK<br>LTTVDIVTLRVLCREGVRWRVMAIQDFKPF<br>ENLRLMAPISLQVVHVETHRCNISWEISQAS<br>HYFERHLEFEARTLSPGHTWEEAPLLTLKQ<br>KQEWICLETLTPDTQYEFQVRVKPLQGEFT<br>TWSPWSQPLAFRTKPAALGKD<br>(SEQ ID NO: 38) |
| AK440 | DNA544 | Knob:<br>hFc(N297A)-<br>[VPLSLY]-<br>hIL2<br>(R38A,<br>F42A,<br>Y45A,<br>E62A, | APTSSSTKKTQL<br>(SEQ ID NO: 29) QLEHLLLDLQMI<br>LNGINNYKNPKL<br>TAMLTAKFAMP<br>KKATELKHLQCL<br>EEALKPLEEVLN<br>LAQSKNFHFDP<br>RDWSNIMVFVL<br>SIKGSETTFMCE | DKTHTCPPCPAPELLGGPSVFLFPPKPKDT<br>LMISRTPEVTCVVVDVSHEDPEVKFNWYVD<br>GVEVHNAHTKPREEQYASTYRVVSVLTVLH<br>QDWLNGKEYKCKVSNKALPAPIEKTISKAK<br>GQPREPQVVTLPPCRDELTKNQVSLWCLVK<br>GFYPSDIAVEWESNGQPENNYKTTPPVLDS<br>DGSFFLYSKLTVDKSRWQQGNVFSCSVMHE<br>ALHNHYTQKSLSLSPGGSPGVPLSLYSGPA<br>PTSSSTKKTQLQLEHLLLDLQMIINGINNY |

-continued

| | | | |
|---|---|---|---|
| AK441 | | L80F, R81D, L85V, I85V, I92F, C125A) | YADETATIVEFL NRWITFAQSII STIT (SEQ ID NO: 328) | KNPKLTAMLTAKFAMPKKATELKHLQCLEE ALKPLEEVLNLAQSKNFHFDPRDWSNINVF VLELKGSETTFMCEYADETATIVEFLNRWI TFAQSIISTLT (SEQ ID NO: 375) |
| AK441 | DNA543 | Hole: hFc(N297A)- [VPLSLY]- hCD122 | GSGGG (SEQ ID No: 31) | AVNGTSQFT CFYNSRANI SCVWSQDGA LQDTSCQVH AWPDRRRWN QTCELLPVS QASWACNL ILGAPDSQK LTTVDIVTL RVLCREGV RWRVM AIQDFKPFE NLRLMAPIS LQVVHVETH RCNI SWEISQASH YFERHLEFE ARTLSPGHT WEEA PLLTLKQKQ EWICLETLT PDTQYEFQV RVKP LQGEFTTWS PWSQPLAFR TKPAALGKD (SEQ ID NO: 4) | DKTHTCPPCPAPELLGGPSVFLFPPKPKDTL MISRTPEVTCVVVDVSHEDPEVKFNWYVDG VEVHNAKTKPREEQYASTYRVVSVLTVLHQ DWLNGKEYKCKVSNKALPAPIEKTISKAKG QPREPQVCTLPPSRDELTKNQVSLSCAVKG FYPSDIAVEWESNGQPENMYKTTPPVLDSD GSFFLVSKLTVDKSRWQQGNVFSCSVMHEA LHNHYTQKSLSLSPGGPSGSSPGVPLSLY GSGGAVNGTSQFTCFYNSRANISCVWSQD GALQDTSCQVHAWPDRRRWNQTCELLPVSQ ASWACNLILGAPDSQKLTTVDIVTLRVLCR EGVRWRVMAIQDFKPFENLRLMAPISLQVV HVETHRCNISWEISQASHYFERHLEFEART LSPGHTWEEAPLLTLKQKQEWICLETLTPD TQYEFQVRVKPLQGEFTTWSPWSQPLAFRT KPAALGKD (SEQ ID NO: 42) |
| AK441 | DNA546 | Knob: hFc (N297A) - hIL2 (R3SA, F42A, Y45A, E62A, L30F, R81D, I85V, I86V, I32F, C125A) | | DKTHTCPPCPAPELLGGPSVFLFPPKPKDT LMISRTPEVTCVVVDVSHEDPEVKFNWYV DGVEVHNAKTKPREEQYASTYRWSVLTVLH QDWINGKEYCKVSNKALPAPIEKTISKAK GQPREPQVVTLPPCRDELTKNQVSLWCLVK GFYPSDIAVEWESNGQPENNYKTTPPVLDS DGSFLYSKLITVQKSRWQQCNVFSCSVMHE ALHNHYTQKSLSLSPGGGSSPPGGGSSGG GSGPATSSSTKKTQLQLEHLLLDLQMILN GINNYKNPKLTAMLTAKFAMPKKATELKH LQCLEEALKPLEEVLNLAQSKNFHFDPRDV VSNINVFLVELKGSETTFMCEYADETATIV EFLNRWITFAQSHSTLT (SEQ ID NO: 377) |

309 310

| AK442 | DNA255 | Knob: hFc(N297A)- hIL2(R33A, F42A, Y45A, E62A, C125A) | | DKTHTCPPCPAPELLGGPSVFLFPPKPKBTL MISRTPEVTCVVDVSHEQPEVKFNWYVDGV EVHNAKTKPREEQYASTYRVVSVLTVLHQD WLNGKEYKCKVSNKALPAPIEKTISKAKGQ PREPQVYTLPPCRDELTKNQVSLWCLVKGF YPSDIAVEWESNIGQPENNYKTPPVLDSD GSFFLYSKLTVDKSRWQQGNVFSCSVMHEA LHNHYTQKSLSLSPGGSSPPGGGSSGGGS GPAPTSSSTKKTQLQLEHLLLDLQMILNGI NNYKNPKLTAMLTAKFAMPKKATELKHLQC LEEALKPLEEVLNLAQSKNFHLRPRDLISN INVIVLELKGSETTFMCEYADETATIVEFL NRWITFAQSIISTLT(SEQ ID NO: 51) |
|---|---|---|---|---|
| AK442 | DNA553 | Hole: hFc(N297A)- [DSGGFMLT]- hCD122 | AVNGTSQFT CFYNSRANI SCVWSQDGA LQDTSCQVH AWPDRRRWN QTCELLPVS QASWACNL ILGAPDSQK LITVDIVTL RVLCREGV RWRVM AIQDFKPFE NLRLMAPIS LQVVHVETH RCNI SWEISQASH YPERHLEFE ARTLSPGHT WEEA PLLTLKQKQ EWICLETLT PDTQYEFQV RVKP LQGEFTTWS PWSQPLAFR TKPAALGKD (SEQ ID NO: 4) SGGG (SEQ ID NO: 30) | DKTHTCPPCPAPELLGGPSVFLFPPKPKDTL MISRTPEVTCVVVDVSHEDPEVKFNWYVDG VEVHNAKTKPRFEQYASTYRVVSVLTVLHQ DWLNGKEYKCKVSNKALPAPIEKTISKAKG QPREPQVCTLPPSRDELTKNQVSLSCAVKG FYPSDIAVEWESNGQPENNYKTTRPVLDSD GSFFLVSKLTVDKSRWQQGNVFSCSVMHEA LHNHYTQKSLSLPGGPPSGSSPGDSGGFM LTSGGAVNGTSQFTCFYNSRANISCVWSQ DGALQDTSCQVHAWPDRRRWNQTCELLPVS QASWACNLILGAPDSQKLITTVDIVTLRVLC REGVRWRVMAIQDFKPFENLRLMAPISLQW HVETHRCNISWEISQASHYFERHLEFEART LSPGHTWEEAPLLTLKQKQEWICLETLTPD TQYEFQVRVKPLQGEFTTWSPWSQPLAFRT KPAALGKD (SEQ ID NO: 41) |
| AK443 | DNA187 | Hole: hFc(N297A)- hCD122 | | DKTHTCPPCPAPELLGGPSVFLFPPKPKDT LMISRTPEVTCVVVDVSHEDPEVKFNWYVD GVEVHNAKTKPREEQYASTYRWSVLTVLHQ DWLNGKEYKCKVSNKALPAPIEKTISKAKG QPREPQVCTLPPSRDELTKNQVSLSCAVKG FYPSDIAVEWESNGQPENNYKTTPPVLDSD GSFFLVSKLTVDKSRWQQGNVFSCSVMHEA LHNHYTQKSLSLPGP6SGSAVNGTSQFTC FYNSRANISCVWSQDGALQDTSCQVHAWPD RRRWNQTCELLPVSQASWACNLILGAPDSQK |

| | | | |
|---|---|---|---|
| AK443 | DNA554 | Knob: hFc(N297A)-[VPLSLY]-hIL2 (E15R, L18C, D20R, R38A, F42A, Y45A, E62A) | APTSSSTKKTQL QLRHLCLRLQMI LNGSNNYKNPKL TAMLTAKFAMP KKATELKHLQCL EEALKPLEEVLN LAQSKNFHLRPR DLISNINVLEL KGSETTFMCEY ADETATIVEFLN RWITFCQSIIST LT (SEQ ID NO: 339) | LTTVDIVTLRVLCREGVRNRVMAIQDFKPF ENLRLMAPISLQVVHVETHRCNISWEISQAS HYFERHLEFEARTLSPGHTWEEAPLLTLKQ KQEWICLETLTPDTQYEFQVRVKPLQGEFT TWSPWSQPLAFRTKPAALGKD (SEQ ID NO: 38) DKTHTCPPCPAPELLGGPSVFLFPPKPKDT LMISRTPEVTCVVVDVSHEDPEVKFNWYVD GVEVHNAKTKPREEQYASTYRVVSVLTVLH QDWLNGKEYKCKVSNKALP APIEKHSKAKGQPREPQVVTLPPCRDELTK NQVSLWCLVKGFYPSDIAVEWESNGQPENN YKTTPPVLDSDGSFFLYSKLTVDKSRW QQGNVFSCSVMHEALHNHYTQQKSLSLSPG GSPGVPLSLYSGPAPTSSSTKKTQLQLRHL CLRLQMILNGINNYKNPKLTAMLTAKFAMP KKATELKHLQCLEEALKPLEEVLNLAQSKN FHLRPRDLISNINIVLELKGSETTFMCEY ADETATIVERNRWITFCQSIISTLT (SEQ ID NO: 385) |
| AK444 | DNA281 | Knob: hFc(N297A), [DSGGFMLT]-hIL2 (R38A, F42A, Y45A, E62A, C125A) | APTSSSTKKTQL QLEHLLLDLQMI LNGINNYKNPKL TAMLTAKFAMP KKATELKHLQCL EEALKPLEEVLN LAQSKNFHLRPR DLISNINVIVL ELKGSETTFMC EYADETATIVEF LNRWITFAQSII STLT (SEQ ID NO: 3) | DKTHTCPPCPAPELLGGPSVFLFPPKPKDT IMISRTPEVTCVVVDVSHEDPEVKFNWYVD GVEVHNAKTKPREEQYASTYRVVSVLTVLH QDWLNGKEYKCKVSNKALPAPIEKHSKAKG QPREPQVVTLPPCRDELTKNQVSLMCLVKG FYPSDIAVEWESNGQPENNYKTTPPVLDSD GSFFLYSKLTVDKSRWQQGNVFSCSVMHEA LHNHYTQKSLSLSPGGSGPDSGGFMLTSGP APTSSSTKKTQLQIEHLLLDLQMILNGINN YKNPKLTAMLTAKFAMPKKATELKHLQCLE EALKPLEEVLNLAQSKNFHLRPRDLISNIN VIVLELKGSETTFMCEYADETAnVEFLNRW ITFAQSIISTLT (SEQ ID NO: 48) |
| AK444 | DNA440 | Hole: hFc(N297A)-hCD122 (C122S, C168S) | | DKTHTCPPCPAPELLGGPSVFLFPPKPKDT LMISRTPEVTCVVVDVSHEDPEVKFNWYVD GVEVHNAKTKPRGEQYASTYRVVSVLTVLH QDWLNGKEYKCKV SNKALPAPIEKTISKAKGQPREPQVCTLPP SRDELTKNQVSLSCAVKGFYPSDLDSGSFFLVSKLTV SNGQPENNYKTTPPVLDSDGSFFLVSKLTV DKSRWQQGNVFSCSVMHEALHNHYTQKSLS LSPGPGSGSAVNGTSQFTCFYNSRANISCV WSQDGALQDTSCQVHAWPORRRWNQTCELL PVSQASWACNLILGAPDSQKLTTVDIVTLR VLCREGVRNRVMAIQDFKPFENLRLMAPIS LQVVHVETHRSNISWEISQASHYFERHLEFE ARTLSPGHTWEEAPLLTLKQKQEWISLETL TPDTQYEFQVRVKPLQGEFTTVVSPWSQPL AFRTKPAALGKD (SEQ ID NO: 39) |

| | | | |
|---|---|---|---|
| AK449 | DNA547 | Hole: hFcIgG1 (N297A)-hCD122 | EPKSSDKTHTCPPCPAPELLGGPSV FLFPPKPKDTLMISRTPEVTCVVVD VSHEDPEVKFNWYVDGVEVHNAKTK PREEQYASTYRVVSVLTVLHQDWLN GKEYKCKVSNKALPAPIEKTISKAK GQPREPQVCLPPSRDELTKNQVSLS CAVKGFYPSDIAVEWESNGQPENNY KTTPPVLDSDGSFFLVSKLTVCKSR WQQGNVFSCSVMHEALHNHYTQKSL SLSPGPGSGSAVNGTSQFTCFYMSR ANISCVWSQDGALQDTSCQVHAWPD RRRWNQTCELLPVSQASWACNLILG APDSQKLTTVDIVTLRVLCREGVRM RVMAIQDFKPFENLRLMAPISLQVVH VETHRCNISWEISQASHYFERHLEF EARTLSPGHTWEEAPLLTLKQKQEW ICLETLTPDTQYEFQVRVKPLQGEF FTWSPWSQPLAFRTKPAALGKD (SEQ ID NO: 378) |
| AK449 | DNA550 | Knob: hFcIgG1 (N297A + EPKSS)-hIL2 (R38A, F42A, Y45A, E62A, C125A) | APTSSSTKKTQL QLEHLLLDLQMI LNGINNYKNPKL TAMLTAKFAMP KKATELKHLQCL EEALKPLEEVLN LAQSKNFHLRPR DLISNINVIVLEL KGSETTFMCEY ADETATIVEFLN RWITFAQSIISTL T (SEQ ID NO: 3) | EPKSSDKTHTCPPCPAPELLGGPVF LFPPKPKDTLMISRTPEVTCVVVDV SHEDPEVKFNWY VDGVEVHNAKTKPREEQYASTFYRV VSVLTVLHQDWLNGKEYKCKVSNKA LPAPIEKTISKAKGQPREPQVYTLP PCRDELTKNQVSLMCLVKGFYPSDI AVEWESNGQPENNYKTTPPVLDSDG SFFLYSKLTVDKSRWQQGNVFSCSV MHEALHNHYTQKSLSLSPGGSPGVP LSLYSGPAPTSSSTKKTQLQLEHLL LDLQMILNGINNYKNPKLTAMLTAK FAMPKKATELKHLQCLEEALKPLEE VLNLAQSKNFHLRPRDLISNINVIV LELKGSETTFMCEYADETATIVEFL NRWITFAQSIISTLT (SEQ ID NO: 381) |
| AK449 | DNA548 | Hole: hFcIgG1 (N297A + AKT)-hFc (N297A)-hCD122 | AKTDKTHTCPPCPAPELLGGPSVFL FPPKPKDTLMISRTPEVTCVVVDVS HEDPEVKFNWYVDGVEVHNAKTKPR EEQYASTYRVVSVLTVLHQDWLNGK EYKCKVSNKALPAPIEKTISKAKGQ PREPQVCTLPPSRDELTKNQVSLSC AVKGFYPSDIAVEWESNGQPENNYK TTPPVLDSDGSFFLVSKLTVDKSRW QQGNVFSCSVMHEALHNHYTQKSLS LSPGPGSGSAVNGTSQFTCFYNSRA NISCVWSQDGALQDTSCQVHAWPDR RRWNQTCELLPVSQASWACNLILGA PDSQKLTTVDIVTLRVLCREGVRWR VMAIQDFKPFENLRLMAPISLQVVH |

| | | | -continued | |
|---|---|---|---|---|
| AK450 | DNA551 | Knob: hFcIgG1 (N297A + AKT)-[VPLSLY]-hIL2 (R38A, F42A, Y45A, E62A, C125A) | SGP APTSSSTKKTQL QLEHLLLDLQMI LNGINNYKNPKL TAMLTAKFAMP KKATELKHLQCL EEALKPLEEVLN LAQSKNFHLRPR DLISNINVIVLEL KGSETTFMCEY ADETATIVEFLN RWITFAQSIISTL T (SEQ ID NO: 3) | AKTDKTHTCPPCPAPELLGGPSVFL FPPKPKDTLMISRTPEVTCVVVDVS HEDPEVKFNWYVDGVEVHNAKTRPR EEQYASTYRVVSVLTVLHQDWLNGK EVKCKVSNKALPAPIEKTISKAKGQ PREPQVYTLPPCRDELTKNQVSLWC LVKGFYPSDIAVEWESNGQPENNYK TTPPVLDSDQSFFLYSKLTVDKSRW QQGIWFSCSVMHEALHNHYTQKSLS LSPGGSPGVPLSLYSGPAPTSSSTK KTQLQLEHLLLDLQMILNGINNYKN PKLTAMLTAKFAMPKKATELKHLQC LEEALKPLEEVLNLAQSKNFHLRPR DLISNINVIVLELKGSETTFMCEYA DETATIVEFLNRWITFAQSIISTLT (SEQ ID NO: 382) |
| AK451 | DNA549 | Knob: hFcIgG1 (N297A + AKTEPKSS)-hCD122 | | AKTEPKSSDKTHTCPPCPAPELLGG PSVFLFPPKPKDTLMISRTPEVTCV VVDVSHEDPEVKFNWYVDGVEVHNA KTKPREEQYASTYRVVSVLTVLHQD WLNGKEYKCKVSNKALPAPIEKTIS KAKGQPREPQVCTLPPSRDEITKNQ VSLSCAVKGFYPSDIAVEWESNGQP ENNYKTTPPVLDSDGSFFLVSKLTV DKSRWQQGNVFSCSVMHEALHNHYT QKSLSLSPGPGSGSAVNGTSQFTCF YNSRANISCVWSQDGALQPTSCQVH AWPDRRRMNQTCELLPVSQASWACN LILGAPDSQKLTTVDIVTLRVLCRE GVRWRVMAIQDFKPFENLRLMAPIS LQVVHVETHRCNISWEISQASHYPER HLEFEARTLSPGHTWEEAPLLTLKQ KQEWICLETLTPDTQYEFQVRVKPL QGEFTTWSPWSQPLAFRTKPAALGK D (SEQ ID NO: 380) |
| AK451 | DNA552 | Knob: hFcIgG1 (N297A + AKTEPKSS)-[VPLSLY]-hIL2 (R38A, F42A, Y45A, | SGP APTSSSTKKTQL QLEHLLLDLQMI LNGINNYKNPKL TAMLTAKFAMP KKATELKHLQCL EEALKPLEEVLN LAQSKNFHLRPR DLISNINVIVLEL KGSETTFMCEY ADETATIVEFLN | AICTEPKSSDKTHTCPPCPAPELLG GPSVFLFPPKPKDTLMISRTPEVTC VVDVSHEDPEVKFNWYVDGVEVHN AKTKPREEQYASTYRVVSVLTVLHQ DWLNGKEYKCKVSNKALPAPIEKLIS KAKGQPREPQVYTLPPCRDELTKNQ VSLWCLVKGFYPSDIAVEWESNGQP ENNYKTTPPVLDSDGSFFLYSKLTV DKSRWQQSNVFSCSVMHEALHNHYT QKSLSLSPGGSPGVPLSLYSGPAPT |

(Partial continuation, top of page:)

VETHRCNISWEISQASHYPERHLEF
EARTLSPGHTWEEAPLLTLKQKQEW
ICLETLTPDTQYEFQVRVKPLQGEF
TTWSPWSQPLAFRTKPAALGKD
(SEQ ID NO: 379)

| | | -continued | |
|---|---|---|---|
| AK452 | | E62A, C125A) | RWITFAQSIISTL T (SEQ ID NO: 3) SSSTKKTQLQLEHLLDLQMILNGI NNYKNPKLTAMLTAKFAMPKKATEL KHLQCLEEALKPLEEVLNLAQSKNF HLRPRDLISNINIVLELKGSETTF MCEYADETATIVEFLNRWITFAQSI STLT(SEQ ID NO: 383) |
| AK452 | DNA187 | Hole: hFc(N297A)- hCD122 | DKTHTCPPCPAPELLGGPSVFLFPPKPKDT LMISRTPEVTCVVVDVSHEDPEVKFNWYVD GVEVHNAKTKPREEQYASTYRVVSVLTVLHQ DWLNGKEYKCKVSNKALPAPIEKTISKAKG QPREPQVCTLPPSRDELTKNQVSLSCAVKG FYPSDIAVEWESNGQPENNYKTTPPVLDSD GSFFLVSKLTVDKSRWQQGNVFSCCSVMHEA LHNHYTQKSLSLSPGKGSSAVNGTSQFTC FYNSRANISCVWSQDGALQDTSCQVHAWPD RRRWNQTCELLPVSQASWACNLILGAPDSQK LTTVDIVTLRVLCREGVRNRVMAIQDFKPF HYFERHLEFEARTLSPGHTWEEAPLLTLKQ KQEWICLETLTPDTQYEFQVRVKPLQGEFT TWSPWSQPLAFRTKPAALGKD (SEQ ID NO: 38) |
| AK452 | DNA563 | Knob: hFc (N297A) [VPLSLY]- hIL2 (R38A, F42A, Y45A, E62A, C125A) | APTSSSTKKTQL QLRHLCLRLQMI LNGINNYKNPKL TAMLTAKFAMP KKATELKHLQCL EEALKPLEEVLN LAQSKNFHLRPR DLISLINVIVLE LKGSETTPMCEY ADETATIVEFLN RWITFCQSIIST LT (SEQ ID NO: 340) DKTHTCPPCPAPELLGGPSVFLFPPK PKDTLMISRTPEVTCVVVDVSHEDP EVKFNWYVDGVEVHNAKTKPREEQY ASTYRVVSVLWLHQDWLNGKEYKCK VSNKALPAPIEKTISKAKGQPREPQ VYTLPPCRDELTKNQVSLMCLVKGF YPSDIAVEWESNGQPENNYKTTPPV IDSDGSFFLYSKLMDKSRVYQQGNV FSCSVMHEALHNHYTQKSLSLSPGG SPGVPLSLYSGPAPTSSSTKKTQLQ LRMLCLRLQMILNGINNYKNPKLTA MLTAKFAMPKKATELKHLQCLEEAL KPLEEVLNLAQSKNFHLRPRDLISL INVIVLELKGSETTPMCEYAOETAT IVEFLNRWITFCQSIISTLT (SEQ ID NO: 386) |
| AK453 | DNA187 | Hole: hFc(N297A)- hCD122 | DKTHTCPPCPAPELLGGPSVFLFPPKPKDT LMISRTPEVTCVVVDVSHEDPEVKFNWYVD GVEVHNAKTKPREEQYASTYRWSVLTVLHQ DWLNGKEYKCKVSNKALPAPIEKTISKAKG QPREPQVCTLPPSRDELTKNQVSLSCAVKG FYPSDIAVEWESNGQPENNYKTTPPVLDSD GSFFLVSKLTVDKSRWQQGNVFSCCSVMHEA LHNHYTQKSLSLSPGKGSSAVNGTSQFTC FYNSRANISCVWSQDGALQDTSCQVHAWPD RRRWNQTCELLPVSQASWACNLILGAPDSQK LTTVDIVTLRVLCREGVRNRVMAIQDFKPF ENLRLMAPISLQVHVETHRCNISWEISQAS |

-continued

| | | | | | |
|---|---|---|---|---|---|
| | | | | | HYFERHLEFEARTLSPGHTWEEAPLLTLKQ KQEWICLETLTPDTQYEFQVRVKPLQGEFT TWSPWSQPLAFRTKPAALGKD (SEQ ID NO: 38) |
| AK453 | DNA565 | Knob: hFc (N297A) [VPLSLY]- hIL2 (E15R, L18C, D20R, R38A, F42A, Y45A, E62A, N88L) | SGP (SEQ ID NO: 29) | APTSSSTKKTQL QLLHLCLRLQMI LNGINNYKNPKL TAMLTAKFAMP KKATELKHLQCL EEALKPLEEVLN LAQSKNFHLRPR DLISLINVIVLE LKGSETTFMCEY ADETATIVEFLNR WITFCQSIISTLT (SEQ ID NO: 341) | DKTHTCPPCPAPELLGGPSVFLFPPK PKDTLMISRTPEVTCVVVDVSHEDP EVKFNWYVDGVEVHNAKTKPREEQY ASTYRVVSVLWLHQDWLNGKEYKCK VSNKALPAPIEKTISKAKGQPREPQ VCTLPPCRDELTKNQVSLWCLVKGF YPSDIAVEWESMGQPENNYKTTPPV LDSDGSFFLYSKLTVDKSRWQQGNV FSCSVMHEALHNHYTQKSLSLSPGG SPGVPLSLYSGPAPTSSSTKKTQLQ LLHLCLRLQMILNGINNYKNPKLTA MLTAKFAMPKKATELKHLQCLEEAL KPLEEVLNLAQSKNFHLRPRDLISL INVIVLELKGSETTFMCEYADETAT IVEFLNRWITFCQSIISTLT (SEQ ID NO: 387) |
| AK454 | DNA187 | Hole: hFc(N297A)- hCD122 | | | DKTHTCPPCPAPELLGGPSVFLFPPKPKDT LMISRTPEVTCVVVDVSHEDPEVKFNWYVD GVEVHNAKTKPREEQYASTYRWSVLTVLHQ DWLNGKEYKCKVSNKALPAPIEKTISKAKG QPREPQVCTLPPSRDELTKNQVSLSCAVKG FYPSDIAVEWESNGQPENNYKTTPPVLDSD GSFFLVSKLTVDKSRWQQGNVFSCSVMHEA LHNHYTQKSLSLSPGP6SGSAVNGTSQFTC FYNSRANISCVWSQDGALQDTSCQVHAWPD RRRWNQTCELLPVSQASWACNLILGAPDSQK LTTVDIVTLRVLCREGVRWRVMAIQDFKPF ENLRLMAPISLQVVHVETHRCNISWEISQAS HYFERHLEFEARTLSPGHTWEEAPLLTLKQ KQEWICLETLTPDTQYEFQVRVKPLQGEFT TWSPWSQPLAFRTKPAALGKD (SEQ ID NO: 38) |
| AK454 | DNA566 | Knob: hFc (N297A)- [VPLSLY] hIL2 (E15R, L18C, R38A, F42A, Y45A, E62A, | SGP (SEQ ID NO: 29) | APTSSSTKKTQL QLRHLCLDLQM ILNGINNYKNPK LTAMLTAKFAM PKKATELKHLQC LEEALKPLEEVL NLAQSKNFHLR PRDLISLINVIVL ELKGSETTFMCE YADETATIVEFL NRWITFCQSIIS | DKTHTCPPCPAPELLGGPSVFLFPPK PKDTLMISRTPEVTCVCCDVSHEDP EVKFNWYVDGVEVHNAKTKPREEQY ASTYRVVSVLTVLHQDWLNGKEYKC KVSNKALPAPIEKTISKAKGQPREP QVYTLPPCRDELTKMQVSLWCLVKG FYPSDIAVEWESNGQPENNYKTTPP VLDSDGSFFLYSKLTVDKSRWQQGN VFSCSVMHEALHNHYTQKSLSLSPG GSPGVPLSLYSGPAPTSSSTKKTQL QLRHLCLDLQMILMGINNYKNPKLT |

| | | | |
|---|---|---|---|
| AK455 | DNA187 | N88L) | AMLTAKFAMPKKATELKHLQCLEEA LKPLEEVLNWQSKNFHLRPRDLISL INVIVLELKGSETTFMCEYADETAT IVEFLNRVVITFCQSIISTLT (SEQ ID NO: 388) |
| AK455 | DNA187 | Hole: hFc(N297A)- hCD122 | SGP (SEQ ID NO: 29) | DKTHTCPPCPAPELLGGPSVFLFPPKPKDT LMISRTPEVTCVVVDVSHEDPEVKFNWYVD GVEVHNAKTKPREEQYASTYRWSVLTVLHQ DWLNGKEYKCKVSNKALPAPIEKTISKAKG QPREPQVCTLPPSRDELTKNQVSLSCAVKG FYPSDIAVEWESNGQPENNYKTTPPVLDSD GSFFLVSKLTVDKSRWQQGNVFSCSVMHEA LHNHYTQKSLSLPGP6SGSAVNGTSQFTC FYNSRANISCVWSQDGALQDTSCQVHAWPD RRRWNQTCELLPVSQASWACNLILGAPDSQK LTTVDIVTLRVLCREGVRMRVMAIQDFKPF ENLRLMAPISLQVVHVETHRCNISWEISQAS HYFERHLEFEARTLSPGHTWEEAPLLTLKQ KQEWICLETLTPDTQYEFQVRVKPLQGEFT TWSPWSQPLAFRTKPAALGKD (SEQ ID NO: 38) |
| AK455 | DNA565 | Knob: hFc (N297A) [VPLSLY]- hIL2 (L18C, D20R, R38A, F42A, Y45A, E62A, N88L) | APTSSSTKKTQL QLEHLCLRLQMI LNGINNYKNPKL TAMLTAKFAMP KKATELKHLQCL EEALKPLEEVLN LAQSKNFHLRPR DLISLINVIVLEL KGSETTFMCEYA DETATIVEFINR WITFCQSIISTLT (SEQ ID NO: 343) | DKTHTCPPCPAPELLGGPSVFLFPP PKPKDTLMISRTPE VTCVVVDVSHEOPEVKFNWYVDGVE VHNAKTKPREEQYASTYRVVSVLTV LHQDWLNGKEYKCKVSNKALPAPIE KTISKAKGQPREPQVYTLPPCRDEL TKMQVSLMCLVKGFYPSDIAVEWES NGQPENNYKTTPPVLDSDGSFFLYS KLTVDKSRWQQGNVFSCSVMHEALH NHYTQKSLSLSPGGSPGVPLSLYSG PAPTSSSTKICTQLQLEHLCLRLQM ILNGINNYKNPKLTAMLTAKFAMPK KATELKHLQCLEEALKPLEEVLNLA QSKNFHLRPRDLISLINVIVLELKG SETTFMCEYADETATIVEFLNRWIT FCQSIISTLT (SEQ ID NO: 389) |
| AK456 | DNA187 | Hole: hFc(N297A)- hCD122 | | DKTHTCPPCPAPELLGGPSVFLFPPKPKDT LMISRTPEVTCVVVDVSHEDPEVKFNWYVD GVEVHNAKTKPREEQYASTYRWSVLTVLHQ DWLNGKEYKCKVSNKALPAPIEKTISKAKG QPREPQVCTLPPSRDELTKNQVSLSCAVKG FYPSDIAVEWESNGQPENNYKTTPPVLDSD GSFFLVSKLTVDKSRWQQGNVFSCSVMHEA LHNHYTQKSLSLPGP6SGSAVNGTSQFTC FYNSRANISCVWSQDGALQDTSCQVHAWPD RRRWNQTCELLPVSQASWACNLILGAPDSQK LTTVDIVTLRVLCREGVRNRVMAIQDFKPF ENLRLMAPISLQVVHVETHRCNISWEISQAS |

| | | | -continued |
|---|---|---|---|
| AK456 | DNA568 | Knob: HFc(N297A)- [VPLSLY]- hIL2(E15F, L18C, D20R, R38A, F42A, Y45A, E62A, N88L) | HYFERHLEFEARTLSPGHTWEEAPLLTLKQ KQEWICLETLTPDTQYEFQVRVKPLQGEFT TWSPWSQPLAFRTKPAALGKD (SEQ ID NO: 38) DKTHTCPPCPAPELLGGPSVFLFPPKPKDT LMISRTPEVTCVVVDVSHEDPEVKFNWYVD GVEVHNAKTKPREEQYASTYRVVSVLTVLHQ DWLNGKEYKCKVSNKALPAPIEKTISKAKG QPREPQVYTIPPCRDEITKNQVSLMCIVKG FYPSDIAVEWESNGQPENNYKTTPPVLDSD GSFFLYSKLTVDKSRWQQGNVFSCSVMHEA LHNHYTQKSLSLSPGSPGVPLSLYSGPAP TSSSTKKTQLQLFHLCLRLQMILNGINNYK NPKLTAMLTAKFAMPKKATELKHLQCLEEA LKPLEEVLNLAQSKNFHIRPRDLISLINVI VLELKGSETTFMCEYADETATIVEFLNRWI TFCQSIISTLT (SEQ ID NO: 390) |
| | | SGP (SEQ ID NO: 29) | APTSSSTKKT QLQLFHLCLR LQMILNGINN YKNPKLTAML TAKFAMPKKA TELKHLQCLE EALKPLEEVLN LAQSKNFHLRPR DLISLINVIVLE LKGSETTFMCEY ADETATIVEFLN RWITFCQSIIST LT (SEQ ID NO: 344) |
| AK462 | DNA530 | Knob: MFcIgG1(DAP G)- hIL2(R38A, F42A, Y45A, E62A, C125A) | VRSGCKPCICTVPEVSSVFIFPPKDVLT ITITPKVTCVVVAISKDDPEVQFSWFVDDV EVHTAQTQPREEQFNSTFRSVSELPIMHQD WLNGKEFKCRVNSAAFGAPIEKTISKTKGR PKAPQVYTIPPPKEQMAKDKVSLTCMITDF FPEDITVEWQWNGQPAENYDNTQPIMDTDG SYFVYSDLNVQKSNWEAGNTFTCSVLHEGL HNHHTEKSLSHSPGGGSSPPGGGSGGGSG PAPTSSSTKKTQLQLEHLLLDLQMILNGIN NYKNPKLTAMLTAKFAMPKKATELKHLQCL EEALKPLEEVLNLAQSKNFHLRPRDLISNI NVIVLELKGSETTFMCEYADETATIVEFLN RWITFAQSHSTLT (SEQ ID NO: 369) |
| AK462 | DNA532 | Hole: MFcIgG1 (DAPG) | VRSGCKPCICTVPEVSSVFIFPPKDVLT ITLTPKVTCVVAISKDDPEVQFSWFVDDVE VHTAQTGPREEQFNSTFRSVSELPIMHQDW LNGKEFKCRVNSAAFGAPIEKTISKTKGRP KAPQVYTIPPPKKQMAKDKVSITCMITDFF PEDITVEWQWNGQPAENYKNTQ PIMKTDGSYFVYSKLNVQKSNWEAGNTFTC SVLHEGLHNHHTEKSLSHSPG (SEQ ID NO: 284) |
| AK463 | DNA530 | Knob: MFcIgG1 (DAPG) - hIL2(R38A, F42A, Y45A, E62A, | VRSGCKPCICTVPEVSSVFIFPPKDVLT ITLTPKVTCVVAISKDDPEVQFSWFVDDV EVHTAQTQPREEQFNSTFRSVSELPIMHQD WLNGKEFKCRVNSAAFGAPIEKTISKTKGR PKAPQVTIPPPKEQMAKDKVSLTCMITDFF PEDITVEWQWNGQPAENYDNTQPIMDTDGS YFVYSDLNVQKSNWEAGNTFTCSVLHEGLH |

| | | |
|---|---|---|
| AK463 | DNA533 | C125A) NHHTEKSLSHSPGGGSSPPGGGSGGGSGP APTSSSTKKTQLQLEHLLLDIQMILNGINN YKNPKLTAMLTAKFAMPKKATELKHLQCLE EALKPLEEVLNLAQSKNFHLRPRDLISNIN VIVLELKGSETTFMCEYADETATIVEFLNR WITFAQSHSTLT (SEQ ID NO: 369) |
| | Hole: mFcIgG1 (DAP G)- hCD122 | VRSGCKPGCTVPGVSSVFIFPPKPKDVLTI TLTPKVTCVVVAISKDDPEVQFSWFVDDVE VHTAQTQPREEQFNSTFRSVSELPIMHQDW LNGKEFKCRVNSAAFGAPIEKTISKTKGRP KAPQVYTIPPPKKQPMAKDKVSLTCMITDF FPEDITVEWQWNGQPAENYKNTQPIMKTDG SYFVYSKLNVQKSNWEAGNTFTCSVLHEGL HNHHTEKSLSHSPGPGSGSAVNGTSQFTCF YNSRANISCVWSQPGALQPTSCQVHAWPDR RRWNQTCELLPVSQASWACNLILGAPDSQK LTTVDIVTLRVLCREGVRMRVMAIQDFKPF ENLRLMAPISLQVVHVETHRCNISWEISQAS HYFERHLEFEARTLSPGHTWEEAPLLTLKQ KQEWICLETLTPDTQYEPQVRVKPLQGEFT TTWSPWSQPLAFRTKPAALGKD (SEQ ID NO: 371) |
| AK464 | DNA530 | Knob: mFcIgG1 (DAPG)- hIL2 (R38A, F42A, Y45A, E62A, C125A) | VRSGCKPCICTVPEVSSVFIFPPKPKDVLT ITLTPKVTCVVVAISKDDPEVQFSWFVDDV EVHTAQTQPREEQFNSTFRSVSELPIMHQD WLNGKEFKCRVNSAAFGAPIEKTISKTKGR PKAPQVTIPPPKEQMAKDKVSLTCMITDFF PEDITVEWQWNGQPAENYDNTQPIMDTDGS YFVYSKLNVQKSNWEAGNTFTCSVLHEGLH NHHTEKSLSHSPGGGSSPPGGGSGGGSGP APTSSSTKKTQLQLEHLLLDIQMILNGINN YKNPKLTAMLTAKFAMPKKATELKHLQCLE EALKPLEEVLNLAQSKNFHLRPRDLISNIN VIVLELKGSETTFMCEYADETATIVEFLNR WITFAQSHSTLT (SEQ ID NO: 369) |
| AK464 | DNA534 | Hole: mFcIgG1 (DAP G)- mCD122 | VRSGCKPCICTVPEVSSVFIFPPKPKDVLT ITLTPKVTCVWAISKDDPEVQFSWFV DDVEVHTAQTQPREEQFNSTFRSVSELPIM HQDWLNGKEFKCRVNSAAFGAPIE KTISKTKGRPKAPQVYTIPPPKKQMAKDKV SLTCMITDFFPEDITVEWQWNGQP AENYKNTQPIMKTDGSYFVYSKLNVQKSNW EAGNTFTCSVLHEGLHNHHTEKSL SHSPGPGSGSAVKNCSHLECFYNSRANVSC MWSHEEALNVTTCHVHAKSNLRH WNKITCELTLVRQASWACNLILGSFPPESQSL TSVDLLOINWCWEEKGWRVKTC DFHPFDNLRLVAPHSLQVLHIDTQRCNISW |

| AK465 | DNA531 | Knob: MFcIgG1(DAPG)-[VPLSLY]-hIL2(R38A, F42A, Y45A, E62A, C125A) | SGP (SEQ ID NO: 29) | APTSSSTKKTQL QLEHLLLDLQMI LNGINNYKNPKL TAMLTAKFAMP KKATELKHLQCL EEALKPLEEVLN LAQSKNFHLRPR DLISNINIVLEL KGSETTFMCEY ADETATIVEFLN RWITFAQSIISTL T (SEQ ID NO: 3) | KVSQVSHYIEPYLEFEARRLLGHS WEDASVLSLKQRQQVVLFLEMLIPSTSYEV QVRVKAQRNNTGTWSPWSQPLTFR TRPADPMKE (SEQ ID NO: 372)<br><br>VRSGCKPCICTVPEVSSVFIFPPKPKDVLH TLTPKVTCVVAISKDDPEVQFSWFV DDVEHTAQTQPREEQFNSTFRSVSELPIM HQDWLNGKEFKCRVNSAAFGAPIE KTISKTKGRPKAPQVYTIPPPKEQMAKDKV SLTCMITDFFPEDITVEWQWNGQP AENYDNTQPIMDTGSYFVYSDLNVQKSNV VEAGNTFTCSVLHEGLHNHHTEKS LSHSPGGSPGVPISLYSGPAPTSSSTKKTQ LQLEHLLLDLQMILNGINNYKNPKLTA MLTAKFAMPKKATELKHLQCLEEEALKPLEE VLNLAQSKNFHLRPRDLISNINIVLE LKGSETTFMCEYADETATIVEFLMRWITFA QSIISTLT (SEQ ID NO: 370) |
|---|---|---|---|---|---|
| AK465 | DNA532 | Hole: mFcIgG1 (DAPG) | | | VRSGCKPGCTVPGVSSVFIFPPKPKDVLTI TLTPKVTCVVVAISKDDPEVQFSWFVDDVE VHTAQTQPREEQFNSTFRSVSELPIMHQDW LNGKEFKCRVNSAAFGAPIEKTISKTKGRP KAPQVYTIPPPKKQPMAKDKVSLTCMITDF FPEDITVEWQWNGQPAENYKNTQPIMKTDG SYFVYSKLNVQKSNWEAGNTFTCSVLHEGL HNHHTEKSLSHSPGPGSGSAVNGTSQFTCF YNSRANISCVWSQPGALQPTSCQVHAWPDR RRWNQTCELLPVSQASWACNLLGAPDSQK LTTVDIVTLRVLCREGVRNRVMAIQDFKPF ENLRLMAPISLQVVHVETHRCNISWEISQAS HYFERHLEFARTLSPGHTWEEAPLLTLKQ KQEWICLETLTPDTQYEFQVRVKPLQGEFT TTWSPWSQPLAFRTKPAALGKD (SEQ ID NO: 371) |
| AK466 | DNA531 | Knob: MFcIgG1(DAPG)-[VPLSLY]-hIL2(R38A, F42A, Y45A, E62A, C125A) | SGP (SEQ ID NO: 29) | APTSSSTKKTQL QLEHLLLDLQMI LNGINNYKNPKL TAMLTAKFAMP KKATELKHLQCL EEALKPLEEVLN LAQSKNFHLRPR DLISNINIVLEL KGSETTFMCEY ADETATIVEFLN RWITFAQSIISTL T (SEQ ID NO: 3) | VRSGCKPCICTVPEVSSVFIFPPKPKDVLH TLTPKVTCVVAISKDDPEVQFSWFV DDVEHTAQTQPREEQFNSTFRSVSELPIM HQDWLNGKEFKCRVNSAAFGAPIE KTISKTKGRPKAPQVYTIPPPKEQMAKDKV SLTCMITDFFPEDITVEWQWNGQP AENYDNTQPIMDTGSYFVYSDLNVQKSNV VEAGNTFTCSVLHEGLHNHHTEKS LSHSPGGSPGVPISLYSGPAPTSSSTKKTQ LQLEHLLLDLQMILNGINNYKNPKLTA MLTAKFAMPKKATELKHLQCLEEEALKPLEE VLNLAQSKNFHLRPRDLISNINIVLE LKGSETTFMCEYADETATIVEFLMRWITFA QSIISTLT (SEQ ID NO: 370) |

-continued

| | | | |
|---|---|---|---|
| AK466 | DNA533 | Hole: mFcIgG1 (DAP G)-mCD122 | VRSGCKPCICTVPEVSSVFIFPPKPKDVLT ITLTPKVTCVVWAISKDDPEVQFSWFV DDVEVHTAQTQPREEQFNSTFRSVSELPIM HQDWLNGKEFKCRVNSAAFGAPIE KTISKTKGRPKAPQVYTIPPPKKQMAKDKV SLTCMITDFFPEDITVEWQWNGQP AENYKNTQPIMKTDGSYFVYSKLNVQKSNW EAGNTFTCSVLHEGLHNHHTEKSL SHSPGPGSGSAVKNCSHLECFYNSRANVSC MWSHEEALNVTTCHVHAKSNLRH WNKTCELTILVRQASWACNLILGSFPPESQSL TSVDLLOINWCWEEKGWRVKTC DFHPFDNLRLIVAPHSLQVLHIDTQRCNISW KVSQVSHYIEPYLEFEARRLLGHS WEDASVLSLKQRQQVVLFLEMLIPSTSYEV QVRVKAQRNNTGTWSPWSQPLTFR TRPADPMKE (SEQ ID NO: 372) |
| AK467 | DNA531 | Knob: MFcIgG1 (DAP G)-[VPLSLY]-hIL2 (R38A, F42A, Y45A, E62A, C125A) | APTSSSTKKTQL QLEHLLLDLQMI LNGINNYKNPKL TAMLTAKFAMP KKATELKHLQCL EEALKPLEEVLN LAQSKNFHLRPR DLISNINIVLEL KGSETTFMCEY ADETATIVEFLN RWITFAQSIISTL T (SEQ ID NO: 29) | VRSGCKPCICTVPEVSSVFIFPPKPKDVLH TLTPKVTCVVAISKDDPEVQFSWFV DDVEVHTAQTQPREEQFNSTFRSVSELPIM HQDWLNGKEFKCRVNSAAFGAPIE KTISKTKGRPKAPQVYTIPPPKEQMAKDKV SLTCMITDFFPEDITVEWQWNGQP AENYDNTQPIMDTDGSYFVYSDLNVQKSNV VEAGNTFTCSVLHEGLHNHHTEKS LSHSPGGSPGVPISLYSGPAPTSSSTKKTQ LQLEHLLLDLQMILNGINNYKNPKLTA MLTAKFAMPKKATELKHLQCLEEEALKPLEE VLNLAQSKNFHLRPRDLLISNINVIVLE LKGSETTFMCEYADETATIVEFLMRWITFA QSIISTLT (SEQ ID NO: 370) |
| AK467 | DNA534 | Hole: mFcIgG1 (DAP G)-mCD122 | | VRSGCKPCICTVPEVSSVFIFPPKPKDVLT ITLTPKVTCVVWAISKDDPEVQFSWFV DDVEVHTAQTQPREEQFNSTFRSVSELPIM HQDWLNGKEFKCRVNSAAFGAPIE KTISKTKGRPKAPQVYTIPPPKKQMAKDKV SLTCMITDFFPEDITVEWQWNGQP AENYKNTQPIMKTDGSYFVYSKLNVQKSNW EAGNTFTCSVLHEGLHNHHTEKSL SHSPGPGSGSAVKNCSHLECFYNSRANVSC MWSHEEALNVTTCHVHAKSNLRH WNKTCELTILVRQASWACNLILGSFPPESQSL TSVDLLOINWCWEEKGWRVKTC DFHPFDNLRLIVAPHSLQVLHIDTQRCNISW KVSQVSHYIEPYLEFEARRLLGHS WEDASVLSLKQRQQVVLFLEMLIPSTSYEV QVRVKAQRNNTGTWSPWSQPLTFR TRPADPMKE (SEQ ID NO: 372) |
| AK468 | DNA576 | Hole: hFc (N297A, | | DKTHTCPPCPAPELLGGPSVFLFPPKPKDT LYITREPEVTCVVVDVSHEDPEVKFNWYVD |

-continued

| | | | |
|---|---|---|---|
| | M252Y, S254T, T256E)- hCD122 | | GVEVHNAKTKPREEQYASTYRVVSVLTVLH QDWLNGKEYKCKVSNKALPAPIEKTISKAK GQPREPQVCTLPPSRDELTKNQVSLSCAVK GFYPSDIAVEWESNGQPENNYKTTPPVLDS DGSFFLVSKLTVDKSRWQQGNVFSCSVMHE ALHNHYTQKSLSLSPGSGSAVNGTSQFT CFYNSRANISCVWSQDGALQDTSCQVHAWP DRRRWNQTCELLPVSQASWACNLILGAPDS QKLTTVDIVTLRVLCREGVRWRVMAIQDFK PFENLRLMAPISLQVVHVETHRCNISWEISQ ASHYFERHLEFEARTISPGHTWEEAPLLTL KQKQEWICLETLTPDTQYEFQVRVKPLQGE FTTWSPWSQPLAFRTKPAALGKD (SEQ ID NO: 392) |
| AK468 | DNA580 | Knob: hFc(N297A, M252Y, S254T, T256E)- [VPLSLY]- hIL2(R38A, F42A, Y45A, E62A, C125A) | DKTHTCPPCPAPELLGGPSVFLFPPKPKDT LYITREPEVTCVVVDVSHEDPEVKFNWYVD GVEVHNAKTKPREEQYASTYRVVSVLTVLH QDWLNGKEYKCKVSNKALPAPIEKTISKAK GQPREPQVTLPPCRDELTKNQVSLWCLVK GFYPSDIAVEWESNGQPENNYKTPPVLD SDGSFFLYSKLTVDKSRWQQGNVF SCSVMHEALHNHYTQKSLSLSPGGSPGVPL SLYSGPAPTSSSTKKTQLQLEHLLLDLQMI LNGINNYKNPKITAMLTAKFAMPKKATELK HLQCLEEALKPLEEVLNLAQSKNFHLRPRD LISNINVIVLELKGSETTFMCEYADETATI VEFLNRWITFAQSIISTLT (SEQ ID NO: 396) |
| AK469 | DNA575 | Hole: hFc(N297A, I253A)- HCD122 | APTSSSTKKTQL QLEHLLLDLQMI LNGINNYKNPKL TAMLTAKFAMP KKATELKHLQCL EEALKPLEEVLN LAQSKNFHLRPR DLISNINVIVLEL KGSETTFMCEY ADETATIVEFLN RWITFAQSIISTL T (SEQ ID NO: 3) SGP (SEQ ID NO: 29) | DKTHTCPPCPAPELLGGPSVFLFPPKPKDT LMASRTPEVTCVVVDVSHEDPEVKFNWYVD GVEVHNAIDKPREEQYASTYRVVSVLTVLH QDWLNGKEYKCKVSNKALPAPIEKTISKAK GQPREPQVCTLPPSRDELTKNQVSLSCAVK GFYPSDIAVEWESNGQPENNYKTTPPVLDS DGSFFLVSKLTVDKSRWQQGNVFSCSVMHE ALHNHYTQKSLSLSPGSGSAVNGTSQFT CFYNSRANISCVWSQDGALQDTSCQVHAWP DRRRWNQTCELLPVSQASWACNLILGAPDS QKLTTVDIVTLRVLCREGVRWRVMAIQPFK PFENLRIMAPISLQVVHVETHRCNISWEIS QASHYFERHLEFEARTLSPGHTWEEAPLLT LKQKQEWICLETLTPDTQYEFQVRVKPLQG EFTTVVSPVVSQPLAFRTKPAALGKD (SEQ ID NO: 43) |
| AK469 | DNA577 | Knob: hFc(N297, I253A)- hIL2 (R38A, F42A, | | DKTHTCPPCPAPELLGGPSVFLFPPKPKDT LMASRTPEVTCVVVDVSHEDPEVKFNWYVD GVEVHNAKTKPREEQYASTYRVVSVLTVLH QDWLNGKEYKCKVSNKAIPAPIEKTISKAK GQPREPQVTLPPCRDELTKNQVSLWCLVK GFYPSDIAVEWESNGQPENNYKTTPPVLDS |

| | | -continued | |
|---|---|---|---|
| AK470 | DNA576 | Y45A, E62A, C125A) | DGSFFLYSKLTVDKSRWQQGNVFSCSVMHE ALHNHYTQKSLSLSPGGGSSPPGGGSSGGG SGPAPTSSSTKKTQLQLEHLLLDLQMILNG INNYKNPKLTAMLTAKFAMPKKATELKHLQ CLEEALKPLEEVLNIAQSKNFHLRPRDIIS NINVIVLELKGSETTFMCEYADETATIVEF LNRWITFAQSIISTLT (SEQ ID NO: 393) |
| AK470 | DNA578 | Hole: hFc (N297A, M252Y, S254T, T256E)- hCD122 | DKTHTCPPCPAPELLGGPSVFLFPPKPKDT LYITREPEVTCVVVDVSHEDPEVKFNWYVD GVEVHNAKTKPREEQYASTYRVVSVLTVLH QDWLNGKEYKCKVSNKALPAPIEKTISKAK GQPREPQVCTLPPSRDELTKNQVSLSCAVK GFYPSDIAVEWESNGQPENNYKTTPPVLDS DGSFFLVSKLTVDKSRWQQGNVFSCSVMHE ALHNHYTQKSLSLSPGPGSGSAVNGTSQFT CFYNSRANISCVWSQDGALQDTSCQVHAWP DRRRWNQTCELLPVSQASWACNLLIGAPDS QKLTTVDIVTLRVLCREGVRWRVMAIQDFK PFENLRLMAPISLQVVHVETHRCNISWEISQ ASHYFERHLEFEARTISPGHTWEEAPLLTL KQKQEWICLETLTPDTQYEFQVRVKPLQGE FTTWSPWSQPLAFRTKPAALGKD (SEQ ID NO: 392) |
| AK470 | DNA578 | Knob: hFc (N297A, M252Y, S254T, T256E)- hIL2 (R38A, F42A, Y45A, E62A, C125A) | DKTHTCPPCPAPELLGGPSVFLFPPKPKDT LYITREPEVTCVVVDVSHEDPEVKFNWYVD GVEVHNAKTKPREEQYASTYRVVSVLTVLH QDWLNGKEYKCKVSNKALPAPIEKTISKAK GFYPSDIAVEWESNGQPENNYKTTPPVLSMCLVK GFYPSDIAVEWESNGQPENNYKTTPPVLDS DGSFFLYSKLTVDKSRWQQGNVFSCSVMHE ALHNHYTQKSLSLSPGGGSSPPGGGSSGGG SGPAPTSSSTKKTQLQLEHLILDLQMILNG INNYKNPKLTAMLTAKFAMPKKATELKHLQ CEEALKPLEEVLNLAQSKNFHLRPRDLISN INVIVLELKGSETTFMCEYADETATIVEFL NRWITFAQSIISTLT (SEQ ID NO: 394) |
| AK471 | DNA575 | Hole: hFc (N297A, I253A)- hCD122 | DKTHTCPPCPAPELLGGPSVFLFPPKPKDT LMASRTPEVTCVVVDVSHEDPEVKFNWYVD GVEVHNAIDKPREEQYASTYRVVSVLTVLH QDWLNGKEYKCKVSNKALPAPIEKTISKAK GQPREPQVCTLPPSRDELTKNQVSLSCAVK GFYPSDIAVEWESNGQPENNYKTTPPVLDS DGSFFLVSKLTVDKSRWQQGNVFSCSVMHE ALHNHYTQKSLSLSPGPGSGSAVNGTSQFT CFYNSRANISCVWSQDGALQDTSCQVHAWP DRRRWNQTCELLPVSQASWACNLLIGAPDS QKLTTVDIVTLRVLCREGVRWRVMAIQPFK PFENLRIMAPISLQVVHVETHRCNISWEIS |

| | | | |
|---|---|---|---|
| AK471 | DNA579 | Knob: hFc(N297, I253A)-[VPLSLY]-hIL2(R38A, F42A, Y45A, E62A, C125A) | QASHYFERHLEFARTLSPGHTWEEAPLLT LKQKQEWICLETLTPDTQYEFQVRVKPLQG EFTTVVSPVVSQPLAFRTKPAALGKD (SEQ ID NO: 43) APTSSSTKKTQL QLEHLLLDLQMI LNGINNYKNPKL TAMLTAKFAMP KKATELKHLQCL EEALKPLEEVLN LAQSKNFHLRPR DLISNINVIVLEL KGSETTFMCEY ADETATIVEFLN RWITFAQSIISTL T (SEQ ID NO: 3) |
| AK475 | DNA255 | Knob: hFc(N297A)-hIL2(R38A, F42A, Y45A, E62A, C125A) | DKTHTCPPCPAPELLGGPSVFLFPPKPKDT LMISRTPEVTCVVVDVSHEDPEVKFNWYV DGVEVHNAKTKPREEQYASTYRVVSVLTVL HQDWLNGKEYKCKVSNKALPAPIEKTISKA KGQPREPQVYTLPPCRDELTKNQVSLWCLV KGFYPSDIAVEVESNGQPENNYKTTPPVL DSDGSFFLYSKLTVDKSRWQQGNVFSCSVM HEALHNHYTQKSLSLSPGGGSSPPGGGSSG GGSGPAPTSSSTKKTQLQLEHLLLDLQMIL NGINNYKNPKITAMLTAKFAMPKKATELKH IQCLEEALKPLEEVLNLAQSKNFHLRPRDL ISNINIVLVLELKGSETTFMCEYADETATIV EFLNRWITFAQSIISTLT (SEQ ID NO: 51) |
| AK475 | DNA528 | Hole: hFc(N297A)-hCD122(C168 8) | DKTHTCPPCPAPELLGGPSVFLFPPKPKDT LMISRTPEVTCVVVDVSHEDPEVKFNWYVD GVEVHNAKTKPREEQYASTYRWSVITVLHQ DWINGKEYCKVSNKAIPAPIEKTISKAKG QPREPQVYTLPPSRDELTKNQVSLSCAVKG FYPSDIAVE WESNGQPENNYKTTPPVLDSDGSFFLVSKL TVDKSRWQQGNVFSCSVMHEALHNHYTQKS LSLSPGGSGSAVNGTSQPTCFYNSRANIS CWSQDGALQDTSCQVHAWPDRRRMNQTCE LLPVSQASWACNLILGAPDSQKLTTVDIVTL RVLCREGVRWRVMAIQDFKFPENLRLMAPI SLQVVHVETHRCNISWEISQASHYFERHLEF EARTISPGHTWEEAPLLTLKQKQEWISLET LTPDTQYEFQVRVKPLQGEFTTWSPWSQPL AFRTKPAALGKD (SEQ ID NO: 368) |

-continued

| | | | |
|---|---|---|---|
| AK476 | DNA263 | Knob: hFc(N297A)-[VPLSLY]-hIL2(R38A, F42A, Y45A, E62A, C125A) | APTSSSTKKTQL QLEHLLLDLQMI LNGINNYKNPKL TAMLTAKFAMP KKATELKHLQCL EEALKPLEEVIN LAQSKNFHLRPR DLISNINVIVLEL KGSETTFMCEY ADETATIVEFLN RWITFAQSIISTLI T SGP (SEQ ID NO: 29) | DKTHTCPPCPAPELLGGPSVFLFPPKPKDTL MISRTPEVTCVVVDVSHEDPEVKFNWYVDGV EVHNAKTKPREEQYASTYRVVSVLTVLH QDWLNGKEYKCKVSNKALPAPIEKTISKAK GQPREPQVYTLPPCRDEITKNQVSLWCLVK GFYPSDIAVEWESNGQPENNYKTPPVLDSD GSFFLYSKLTVDKSRWQQGNVFSCSVMHEA LHNHYTQKSLSLSPGGSPGVPLSLYSGPAP TSSSTKKTQLQLEHLLLDLQMILNGINNYK NPKLTAMLTAKFAMPKKATELKHLQCLEEA LKPL6EVLNLAQSKNFHLRPRDLISNINVI VLELKGSETTFMCEYAQETATIVEFLNRWI TFAQSIISTLIT (SEQ ID NO: 49) |
| AK476 | DNA528 | Hole: hFc(N297A)-hCD122(C168S) | | DKTHTCPPCPAPELLGGPSVFLFPPKPKDT LMISRTPEVTCVVVDVSHEDPEVKFNWYVD GVEVHNAKTKPREEQYASTYRWSVITVLHQ DWINGKEYKCKVSNKAIPAPIEKTISKAKG QPREPQVYTLPPSRDELTKNQVSLSCAVKG FYPSDIAVE WESNGQPENNYKTTPPVLDSDGSFFLVSKL TVDKSRWQQGNVFSCSVMHEALHNHYTQKS LSLSPGGSGSAVNGTSQPTCFYNSRANIS CVVVSQDGALQDTSCQVHAWPDRRRWNQTCE LLPVSQASWACNLILGAPDSQKLITVDIVTL RVLCREGVRWRVMAIQDFKPFENLRLMAPI SLQVVHETHRCNISWEISQASHYFERHLEF EARTISPGHTWEEAPLLTLKQKQEWISLET LTPDTQYEFQVRVKPLQGEFTTWSPWSQPL AFRTKPAALGKD (SEQ ID NO: 368) |
| AK477 | DNA158 | Hole: hFc(N297A) | | DKTHTCPPCPAPELLGGPSVFLFPPKPKDTL MISRTPEVTCVVVDVSHEDPEVKFNWYVDGV EVHNAKTKPREEQYASTYRVSVLTVLHQDW LNGKEYKCKVSNKALPAPIEKTISKAKGQPR EPQVCTLPPSRDELTKNQVSLSCAVKGFYPS DIAVEWESNGQPENNYKTTPPVLDSDGSFFL VSKLTVDKSRWQQGMVFSCSVMHEALHNHY TQKSLSLSPG (SEQ ID NO: 9) |
| AK477 | DNA554 | Knob: hFc(N297A)-[VPLSLY]-hIL2(E15R, L18C, D2GR, R38A, F42A, Y45A, E62A) | APTSSSTKKTQL QLRHLCLRLQMI LNGINNYKNPKL TAMLTAKFAMP KKATELKHLQCL EEALKPLEEVIN LAQSKNFHLRPR DLISNINVIVLEL KGSETTFMCEY ADETATIVEFLN | DKTHTCPPCPAPELLGGPSVFLFPPKPKDT LMISRTPEVTCVVVDVSHEDPEVKFNWYVD GVEVHNAKTKPREEQYASTYRVSVITVLH QDWLNGKEYKCKV SNKALPAPIEKTISKAKGQPREPQVYTLPP CRDELTKNQVSLWCLVKGFYPSDIAVEWES NGQPENNYKTTPPVLDSDGSFFLYSKLTVD KSRWQQGNVFSCSVMHEALNHHYTQKSLSL SPGGSPGVPLSLYSGPAPTSSSTKKTQLQL RHLCLRLQMILNGINNYKNPKLTAMLTAKF |

| | | | |
|---|---|---|---|
| AK484 | DNA158 | Hole: hFc(N297A) | RWITFCQSIISTL T (SEQ ID NO: 339) | AMPKKATELKHLQCLEEALKPLEEVLNLAQ SKNFHLRPRDLISNINVIVLELKGSETTFM CEYADETATIVEFLNRWITFCQSIISTLT (SEQ ID NO: 385) |
| AK484 | DNA581 | Knob: hFc(N297A)-[VPLSLY]-hIL2(L18C, R38A, F42A, Y45A, E62A) | APTSSSTKKTQL QLEHLCLDLQM ILNGINNYKNPK L7AMLTAKFAM PKKATELKHLQC LEEALKPLEEVL NLAQSKNFHLR PRDLISNINVIVL ELKGSETTFMCE YADETATIVEFL NRWITFCQSHST LT (SEQ ID NO: 365) | DKTHTCPPCPAPELLGGPSVFLFPPKPKDTL MISRTPEVTCVVVDVSHEDPEVKFNWYVDGV EVHNAKTKPREEQYASTYRVVSVLTVLHQDW LNGKEYKCKVSNKALPAPIEKTISKAKGQPR EPQVCTLPPSRDELTKNQVSLSCAVKGFYPS DIAVEWESNGQPENNYKTTPPVLDSDGSFFL VSKLTVDKSRWQQGMVFSCSVMHEALHNHY TQKSLSLSPG (SEQ ID NO: 9) KTHTCPPCPAPELLGGPSVFLFPPKPKDT LMISRTPEVTCVVVDVSHEDPEVKFNWYVD GVEVHNAKTKPREEQYASTYRVVSVLTVLH QDWLNGKEYKCKVSNKALPAPIEKTISKAK GQPREPQVVTLPPCRDELTKNQVSLWCLVK GFYPSDIAVEWESNGQPENNYKTTPPVLDS DGSFFLY DSKLTVDKSRWQQGNVFSCSVMHEALKNHYT QKSLSLSPGGSPGVPLSLYSGPAFTSSSTK KTQLQLEHLCLDLQMILNGINNYKNPKLTA MLTAKFAMPKKATELKHLQCIEEALKPLEE VLNLAQSKNFHLRPRDLISNINVIVLELKG SETTFMCEYADETATIVEFLNRWITFCQSI ISTLT (SEQ ID NO: 397) |
| AK485 | DNA158 | Hole: hFc(N297A) | SGP (SEQ ID NO: 29) | DKTHTCPPCPAPELLGGPSVFLFPPKPKDTL MISRTPEVTCVVVDVSHEDPEVKFNWYVDGV EVHNAKTKPREEQYASTYRVVSVLTVLHQDW LNGKEYKCKVSNKALPAPIEKTISKAKGQPR EPQVCTLPPSRDELTKNQVSLSCAVKGFYPS DIAVEWESNGQPENNYKTTPPVLDSDGSFFL VSKLTVDKSRWQQGMVFSCSVMHEALHNHY TQKSLSLSPG (SEQ ID NO: 9) |
| AK485 | DNA582 | Knob: HFc(N297A)-[VPLSLY]-hIL2(H16Y, R38A, F42A, Y45A, E62A, C125A) | APTSSSTKKTQL QLEYLLLDLQMI LNGINNYKNPKL TAMLTAKFAMP KKATELKHLQCL EEALKPLEEVIN LAQSKNFHLRPR | DKTHTCPPCPAPELLGGPSVFLFPPKPKDT LMISRTPEVTCVVVDVSHEDPEVKFNWYVD GVEVHNAKTKPREEQYASTYRVVSVLTVLH QDWLNGKEYKCKVSNKALPAPIEKTISKAK GQPREPQVVTLPPCRDELTKNQVSLWCLVK GFYPSDIAVEWESNGQPENNYKTTPPVLDS DGSFFLY |

| | | | |
|---|---|---|---|
| AK486 | DNA158 | Hole: hFc(N297A) | SKLTVDKSRWQQGNVFSCSVMHEALHNHYT QKSLSLSPGGSPGVPLSLYSGPAPTSSSTK KTQLQLEYLLLDLQMILNGINNYKNPKLTA MLTAKFAMPKKATELKHLQCLEEALKPLEE VLNLAQSKNFHLRPRDLISNINVIVLELKG SETTFMCEYADETATIVEFLNRWITFAQSH STLT (SEQ ID NO: 398) |
| AK486 | DNA583 | Knob: hFc(N297A)- [VPLSLY]- hIL2(H16E, R38A, F42A, Y45A, E52A, C125A) | DKTHTCPPCPAPELLGGPSVFLFPPKPKDTL MISRTPEVTCVVVDVSHEDPEVKFNWYVDGV EVHNAKTKPREEQYASTYRVVSVLTVLHQDW LNGKEYKCKVSNKALPAPIEKTISKAKGQPR EPQVCTLPPSRDELTKNQVSLSCAVKGFYPS DIAVEWESNGQPENNYKTTPPVLDSDGSFFL VSKLTVDKSRWQQGMVFSCSVMHEALHNHY TQKSLSLSPG (SEQ ID NO: 9) |
| Ak486 | DNA583 | Knob: hFc(N297A)- [VPLSLY]- hIL2(H16E, R38A, F42A, Y45A, E52A, C125A) | DKTHTCPPCPAPELLGGPSVFLFPPKPKDT LMISRTPEVTCVVVDVS HEDPEVKFNWYVDGVEVHNAKTKPREEQYA STYRVVSVLTVLHQDWLNGKEYKCKVSNKA LPAPIEKTISKAKGQPREPQVYTLPPCRDE LTKNQVSLW CLVKGFYPSDIAVEWESNGQPENNYIQTPP VLDSDGSFFLYSKLTVDKSRWQQGNVFSCS VMHEALHNHYTQKSLSLSPGGSPGVPLSLY SGPAPTSSSTKKTQLQLEELLLDLQMILNG INNYKNPKLTAMLTAKFAMPKKATELKHLQ CLEEALKPLEEVLNLAQSKNFHLRPRDLISN INVIVLELKGSETTFMCEYADETATIVEFL NRWITFAQSIISTLT (SEQ ID NO: 399) |
| AK487 | DNA158 | Hole: hFc(N297A) | DKTHTCPPCPAPELLGGPSVFLFPPKPKDTL MISRTPEVTCVVVDVSHEDPEVKFNWYVDGV EVHNAKTKPREEQYASTYRVVSVLTVLHQDW LNGKEYKCKVSNKALPAPIEKTISKAKGQPR EPQVCTLPPSRDELTKNQVSLSCAVKGFYPS DIAVEWESNGQPENNYKTTPPVLDSDGSFFL VSKLTVDKSRWQQGMVFSCSVMHEALHNHY TQKSLSLSPG (SEQ ID NO: 9) |
| AK487 | DNA584 | Knob: hFc(N297A)- [VPLSLY]- hIL2, (D20L, R3SA, F42A, Y45A, E62A, C125A) | DKTHTCPPCPAPELLGGPSVFLFPPKPKDT LMISRTPEVTCVVVDVSHEDPEVKFNWYVD GVEVHNAKTKPREEQYASTYRVVSVLTVLH QDWLNGKEYKCKVSNKALPAPIEKTISKAK GQPREPQVYTLPPCRDELTKNQVSLWCLVK GFYPSDIAVEWESNGQPENNYKTTPPVLDS DGSFFLYSKLTVDKSRWQQGNVFSCSVMHE ALHNHYTQKSLSLSPGGSPGVPLSLYSGPA PTSSSTKKTQLQLEHLLLLLQMILNGINNY |

Rows continued:

AK486 DNA158: ...DLISNINVIVLEL KGSETTFMCEY ADETATIVEFLN RWITFAQSIISTL T (SEQ ID NO: 346)

AK486 DNA583: APTSSSTKKTQL QLEELLLDLQMI LNGINNYKNPKL TAMLTAKFAMP KKATELKHLQCL EEALKPLEEVIN LAQSKNFHLRPR DLISNINVIVLEL KGSETTFMCEY ADETATIVEFLN RWITFAQSIISTL T SGP (SEQ ID NO: 29) (SEQ ID NO: 347)

AK487 DNA584: APTSSSTKKTQL QLEHLLLLLQMI LNGINNYKNPKL TAMLTAKFAMP KKATELKHLQCL EEALKPLEEVIN LAQSKNFHLRPR DLISNINVIVLEL KGSETTFMCEY SGP (SEQ ID NO: 29)

-continued

| | | | |
|---|---|---|---|
| AK488 | DNA158 | Hole: hFc(N297A) | ADETATIVEFLN RWITFAQSIISTL T (SEQ ID NO: 348) | KNPKLTAMLTAKFAMPKKATELKHLQCLEE ALKPLEEVLNLAQSKNFHLRPRDLISNINV IVLELKGSETTFMCEYADTATIVEFLNRW ITFAQSIISTLT (SEQ ID NO: 400) |
| AK488 | DNA585 | Knob: hFc(N297A)- [VPLSLY]- hIL2(H16Y, R38A, F42A, Y45A, E52A, C125A) | APTSSSTKKTQL QLEYLCLDLQMI LNGINNYKNPKL TAMLTAKFAMP KKATELKHLQCL EERALKPLEEVLN LAQSKNFHLRPR DLISNINVIVLEL KGSETTFMCEY ADETATIVEFLN RWITFCQSIISTL T (SEQ ID NO: 349) | DKTHTCPPCPAPELLGGPSVFLFPPKPKDT LMISRTPEVTCVVVDVSHEDPEVKFNWYVD GVEVHNAKTKPREEQYASTYRVVSVLTVLH QDWLNGKEYKCKVSNKALPAPIEKTISKAK GQPREPQVVTLPPCRDELTKNQVSLWCLVK GFYPSDIAVEWESNGQPENNYKTTPPVLDS DGSFFLYSKLTVDKSRWQQGNVFSCSVMHE ALHNHYTQKSLSLSPGGSPGVPLSLYSGPA PTSSSTKKTQLQLEYLCLDLQMILNGINNY KNPKLTAMLTAKFAMPKKATELKHLQCLEE ALKPLEEVLNLAQSKNFHLRPRDLISNINV IVLELKGSETTFMCEYADTATIVEFLNRW ITFCQSIISTLT (SEQ ID NO: 401) |
| AK489 | DNA158 | Hole: hFc(N297A) | | (SEQ ID NO: 9) |
| AK489 | DNA586 | Knob: hFc(N297A)- [VPLSLY]- hIL2(H16E, L18C, R38A, F42A, Y45A, E62A) | APTSSSTKKTQL QLEELCLDLQMI LNGINNYKNPKL TAMLTAKFAMP KKATELKHLQCL EERALKPLEEVLN LAQSKNFHLRPR DLISNINVIVLEL KGSETTFMCEY ADETATIVEFLN | DKTHTCPPCPAPELLGGPSVFLFPPKPKDT LMISRTPEVTCVVVDVSHEOPEV KFNWYVDGVEVHNAKTKPREEQYASTYRVV SVLTVLHQDVVLNGKEYKCKVSNKALPAPI EKTISKAKGQPREPQVYTLPPCRDELTKNQ VSLWCLVKGFYPSDIAVEWESNGQPEN NYKTTPPVLDSDGSFFLYSKLTVDKSRWQQ GNVFSCSVMHEALHNHYTQKSLSLSPGGSP GVPLSLYSGPAPTSSSTKKTQLQLEELCLD LQMILNGINNYKNPKLTAMLTAKFAMPKKA |

| | | | |
|---|---|---|---|
| AK490 | DNA158 | Hole: hFc(N297A) | RWITFCQSIISTL (SEQ ID NO: 350) TELKHLQCLEEALKPLEEVLNLAQSKNFHL RPRDLISNINVIVLELKGSETTFMCEYADE TATIVEFLNRWITFCQSIISTLT (SEQ ID NO: 402) |
| AK490 | DNA587 | Knob: hFc(N297A)- [VPLSLY]- hIL2(L18C, D20L, R38A, F42A, Y45A, E62A) | APTSSSTKKTQL QLEHLCLLLQMI LNGINNYKNPKL TAMLTAKFAMP KKATELKHLQCL EEALKPLEEVLN LAQSKNFHLRPR DLISNINVIVLEL KGSETTFMCEY ADETATIVEFLN RWITFCQSIISTL T (SEQ ID NO: 351) DKTHTCPPCPAPELLGGPSVFLFPPKPKDT LMISRTPEVTCVVVDVSHEDPEVKFNWYVD GVEVHNAKTKPREEQYASTYRVVSVLTVLH QPWLNGKEYKCKVSNKALPAPIEKTISKAK GQPREPQVYTLPPCRDELTKMQVSLWCLVK GFYPSDIAVEWESMGQPENNYKTTPPVLDS DGSFFLYSKLTVDKSRWQQGNVFSCCSVMHE ALHNHYTQKSLSLSPGGSPGVPLSLYSGPA PTSSSTKKTQLQLEHLCLLLQMILNGINNY KNPKLTAMLTAKFAMPKKATELKHLQCLEE ALKPLEEVLNLAQSKNFHLRPRDLISNINV IVLELKGSETTFMCBYADETATIVEFLNRW ITFCQSIISTLT (SEQ ID NO: 403) |
| AK491 | DNA158 | Hole: hFc(N297A) | APTSSSTKKTQL QLEYLCLLLQMI LNGINNYKNPKL TAMLTAKFAMP KKATELKHLQCL EEALKPLEEVLN LAQSKNFHLRPR DLISNINVIVLEL KGSETTFMCEY ADETATIVEFLN RWITFCQSIISTL T (SEQ ID NO: 352) DKTHTCPPCPAPELLGGPSVFLFPPKPKDT MISRTPEVTCVVVDVSHEDPEVKFNWYVDGV EVHNAKTKPREEQYASTYRVVSVLTVLHQDW LNGKEYKCKVSNKALPAPIEKTISKAKGQPR EPQVCTLPPSRDELTKNQVSLSCAVKGFYPS DIAVEWESNGQPENNYKTTPPVLDSDGSFFL VSKLTVDKSRWQQGMVFSCSVMHEALHNHY TQKSLSLSPG (SEQ ID NO: 9) |
| AK491 | DNA588 | Knob: hFc(N297A)- [VPLSLY]- hIL2(H16Y, L18C, D20L, R38A, F42A, Y45A, E62A) | DKTHTCPPCPAPELLGGPSVFLFPPKPKDT LMISRTPEVTCVVVDVSHEDPEVKFNWYVD GVEVHNAICTKPREEQYASTYRVVSVLTVL HQDWLNGKEYKCKVSNKALPAPIEKTISKA KGQPREPQVYTLPPCRDELTKNQVSLWCLV KGFYPSDIAVEWESNGQPENNYKTTPPVLD SDGSFFLY SKLTVDKSRWQQGNVFSCCSVMHEALHNHYT QKSLSLSPGGSPGVPLSLYSGPAPTSSSTK KTQLQIEYLCLLLQMILNGINNYKNPKLTA MLTAKFAMPKKATELKHLQCLEEALKPLEE VLNLAQSKNFHLRPRDLISNINVIVLELKG SETTFMCEYADETATIVEFLNRWITFCQSI ISTLT (SEQ ID NO: 404) |

| | | | |
|---|---|---|---|
| AK492 | DNA158 | Hole: hFc(N297A) | DKTHTCPPCPAPELLGGPSVFLPPKPKDTL MISRTPEVTCVVVDVSHEDPEVKPNWYVDGV EVHNAKTKPREEQYASTYRVVSVLTVLHQDW LNGKEYKCKVSNKALPAPIEKTISKAKGQPR EPQVCTLPPSRDELTKNQVSLSCAVKGFYPS DIAVEWESNGQPENNYKTTPPVLDSDGSFFL VSKLTVDKSRWQQGMVFSCSVMHEALHNHY TQKSLSLSPG (SEQ ID NO: 9) |
| AK4921 | DNA589 | Knob: hFc(N297A)- [VPLSLY]- hIL2(H16E, L18C, D20L, R38A, F42A, Y45A, E62A) | DKTHTCPPCPAPELLGGPSVFLPPKPKDT LMISRTPEVTCVVVDVSHEDPEVKFNWWDG VEVHNAKTKPREEQYASTYRVVSVLTVLHQ DWLNGKEVCKCKVSNKALPAPIFKTISKAKG QPRFPQVYTLPPCRDELTKNQVSIAVCLVK GFYPSDIAVEWESNGQPENNYKTTPPVLDS DGSFFLYSKLTVDKSRWQQGNVFSCSVMHE ALHNHYTQKSLSLSPGGSPGVPLSLYSGPA PTSSSTKKTQLQLEELCLLLQMILNGINNY KNPKLT AMLTAKFAMPKKATELKHLQCLEEALKPLE EVLNLAQSKNFHLRPRDLISNINIVLELK GSETTFMCEYADETATIVEFLNRWITFCQS IISTLT (SEQ ID NO: 405) |
| | | APTSSSTKKTQL QLEELCLLLQMI LNGINNYKNPKL TAMLTAKFAMP KKATELKHLQCL EEALKPLEEVLN LAQSKNFHLRPR DLISNINIVLEL KGSETTFMCEY ADETATIVEFLN RWITFCQSIISTL T (SEQ ID NO: 353) | |
| | | SGP (SEQ ID NO: 29) | |
| AK493 | DNA187 | Hole: hFc(N297A)- hCD122 | DKTHTCPPCPAPELLGGPSVFLPPKPKDT LMISRTPEVTCVVVDVSHEDPEVKFNWYVD GVEVHNAKTKPREEQYASTYRVVSVLTVLH QDWLKGKEYKCKVSNKALPAPIEKTISKAK GQPREPQVCTLPPSRDELTKNQVSLSCAVK GFYPSDIAVEWESNGQPENNYKTTPPVLDS DGSFFLVSKKLTVDKSRWQQGNVFSCSVMHE ALHNHYTQKSLSLSPG (SEQ ID NO: 38) |
| AK493 | DNA581 | Knob: hFc(N297A)- [VPLSLY]- hIL2(L18C, R38A, F42A, Y45A, E62A) | DKTHTCPPCPAPELLGGPSVFLPPKPKDT LMISRTPEVTCVVVDVSHEDPEVKFNWYVD GVEVHNAKTKPREEQYASTYRVVSVLWLHQ DWLNGKEYCKCKVSNKALPAPIEKTISKAKG QPREPQVYTLPPCRDELTKMQVSLWCLVKG FYPSDIAVEWESNGQPENNVFSCSVMHEA LHNHYTQKSLSLSPGGSPGVPLSLYSGPAP TSSSTKKTQLQLEHLCLDLQMILNGIMNYK NPKLTAMLTAKFAMPKKATELKHLQCLEEA LKPLEEVLNLAQSKNFHLRPRDLISNINVI VLELKGSETTFMCEYAOETATIVEFLNRWI TFCQSIISTLT (SEQ ID NO: 345) |
| | | APTSSSTKKTQL QLEHLCLDLQM ILNGINNYKNPK LTAMLTAKFAM PKKATELKHLQC LEEEALKPLEEVL NLAQSKNFHLR PRDLISNINIVL ELKGSETTFMCE YADETATIVEFL NRWITFCQSIIST LT (SEQ ID NO: 345) | |
| | | SGP (SEQ ID NO: 29) | |
| AK494 | DNA187 | Hole: hFc(N297A)- hCD122 | DKTHTCPPCPAPELLGGPSVFLPPKPKDT LMISRTPEVTCVVVDVSHEDPEVKFNWYVD GVEVHNAKTKPREEQYASTYRVVSVLTVLH (SEQ ID NO: 397) |

| | | | |
|---|---|---|---|
| AK485 | DNA582 | Knob: hFc(N297A)-[VPLSLY]-hIL2(H16Y, R38A, F42A, Y45A, E62A) | APTSSSTKKTQL QLEYLLDLQMI LNGINNYKNPKL TAMLTAKFAMP KKATELKHLQCL EEALKPLEEVIN LAQSKNFHLRPR DLISNINIVLEL KGSETTFMCEY ADETATIVEFLN RWITFAQSIISTL T (SEQ ID NO: 346) | QDWLKGKEYKCKVSNKALPAPIEKTISKAK GQPREPQVCTLPPSRDELTKNQVSLSCAVK GFYPSDIAVEWESNGQPENNYKTTPPVIDS DGSFFLVSKLTVDKSRWQQGNVFSCSVMHE ALHNHYTQKSLSLSPG (SEQ ID NO: 38) |
| | | Hole: hFc(N297A)-[VPLSLY]-hIL2(H16Y, R38A, F42A, Y45A, E62A) SGP (SEQ ID NO: 29) | | DKTHTCPPCPAPELLGGPSVFLFPPKPKDT LMISRTPEVTCVVVDVSHEDPEVKFNWYVD GVEVHNAKTKPREEQYASTYRVVSVLTVLH QDWLNGKEYKCKVSNKALPAPIEKTISKAK GQPREPQVYTLPPCRDELTKNQVSLWCLVK GFYPSDIAVEWESNGQPENNYKTTPPVLDS DGSFFLY SKLTVDKSRWQQGNVFSCSVMHEALHNHYT QKSLSLSPGGSPGVPLSLYSGPAPTSSSTK KTQLQLEYLLLDLQMILNGINNYKNPKLTA MLTAKFAMPKKATELKHLQCLEEALKPLEE VLNLAQSKNFHLRPRDLISNINIVLELKG SETTFMCEYADETATIVEFLNRWITFAQSH STLT (SEQ ID NO: 398) |
| AK495 | DNA187 | Hole: hFc(N297A)-hCD122 | | DKTHTCPPCPAPELLGGPSVFLFPPKPKDT LMISRTPEVTCVVVDVSHEDPEVKFNWYVD GVEVHNAKTKPREEQYASTYRVVSVLTVLH QDWLKGKEYKCKVSNKALPAPIEKTISKAK GQPREPQVCTLPPSRDELTKNQVSLSCAVK GFYPSDIAVEWESNGQPENNYKTTPPVIDS DGSFFLVSKLTVDKSRWQQGNVFSCSVMHE ALHNHYTQKSLSLSPG (SEQ ID NO: 38) |
| AK495 | DNA583 | Knob: hFc(N297A)-[VPLSLY]-hIL2(H16E, R38A, F42A, Y45A, E52A, C125A) SGP (SEQ ID NO: 29) | APTSSSTKKTQL QLEELLLDLQMI LNGINNYKNPKL TAMLTAKFAMP KKATELKHLQCL EEALKPLEEVIN LAQSKNFHLRPR DLISNINIVLEL KGSETTFMCEY ADETATIVEFLN RWITFAQSIISTL T (SEQ ID NO: 347) | DKTHTCPPCPAPELLGGPSVFLFPPKPKDT LMISRTPEVTCVVVDVS HEDPEVKFNWYVDGVEVHNAKTKPREEQYA STYRVVSVLTVLHQDWLNGKEYKCKVSNKA LPAPIEKTISKAKGQPREPQVYTLPPCRDE LTKNQVSLW CLVKGFYPSDIAVEWESNGQPENNYIOTPP VLDSDGSFFLYSKLTVDKSRWQQGNVFSCS VMHEALHNHYTQKSLSLSPGGSPGVPLSLY SGPAPTSSSTKKTQLQLEELLLDLQMILNG INNYKNPKLTAMLTAKFAMPKKATELKHLQ CLEEALKPLEEVLNLAQSKNFHLRPRDLISN INVIVLELKGSETTFMCEYADETATIVEFL NRWITFAQSIISTLT (SEQ ID NO: 399) |
| AK496 | DNA187 | Hole: hFc(N297A)-hCD122 | | DKTHTCPPCPAPELLGGPSVFLFPPKPKDT LMISRTPEVTCVVVDVSHEDPEVKFNWYVD GVEVHNAKTKPREEQYASTYRVVSVLTVLH QDWLKGKEYKCKVSNKALPAPIEKTISKAK GQPREPQVCTLPPSRDELTKNQVSLSCAVK |

| | | | |
|---|---|---|---|
| AK496 | Knob: hFc(N297A)-[VPLSLY]-hIL2,(D20L, R38A, F42A, Y45A, E62A, C125A) | SGP (SEQ ID NO: 29) | APTSSSTKKTQL QLEHLLLLLQMI LNGINNYKNPKL TAMLTAKFAMP KKATELKHLQCL EEALKPLEEVIN LAQSKNFHLRPR DLISNINVIVLEL KGSETTFMCEY ADETATIVEFLN RWITFAQSIISTL T (SEQ ID NO: 348) | GFYPSDIAVEWESNGQPENNYKTPPVIDS DGSFFLVSKLTVDKSRWQQGNVFSCSVMHE ALHNHYTQKSLSLSPG (SEQ ID NO: 38) |
| AK497 | Hole: hFc(N297A)-hCD122 DNA187 | | | DKTHTCPPCPAPELLGGPSVFLFPPKPKDT LMISRTPEVTCVVVDVSHEDPEVKFNWYVD GVEVHNAKTKPREEQYASTYRVVSVLTVLH QDWLNGKEYKCKVSNKALPAPIEKTISKAK GQPREPQVYTLPPCRDELTKNQVSLWCLVK GFYPSDIAVEWESNGQPENNYKTPPVLDS DGSFFLYSKLTVDKSRWQQGNVFSCSVMHE ALHNHYTQKSLSLSPGGSPGVPLSLYSGPA PTSSSTKKTQLQLEHLLLLLQMILNGINNY KNPKLTAMLTAKFAMPKKATELKHLQCLEE ALKPLEEVLNLAQSKNFHLRPRDLISNINV IVLELKGSETTFMCEYADETATIVEFLNRW ITFAQSIISTLT (SEQ ID NO: 400) |
| AK497 | Knob: hFc(N297A)-[VPLSLY]-hIL2(H16Y, R38A, F42A, Y45A, E52A, C125A) DNA585 | SGP (SEQ ID NO: 29) | APTSSSTKKTQL QLEYLCLDLQMI LNGINNYKNPKL TAMLTAKFAMP KKATELKHLQCL EEALKPLEEVLN LAQSKNFHLRPR DLISNINVIVLEL KGSETTFMCEY ADETATIVEFLN RWITFCQSIISTL T (SEQ ID NO: 349) | DKTHTCPPCPAPELLGGPSVFLFPPKPKDT LMISRTPEVTCVVVDVSHEDPEVKFNWYVD GVEVHNAKTKPREEQYASTYRVVSVLTVLH QDWLNGKEYKCKVSNKALPAPIEKTISKAK GQPREPQVCTLPPSRDELTKNQVSLSCAVK GFYPSDIAVEWESNGQPENNYKTPPVIDS DGSFFLVSKLTVDKSRWQQGNVFSCSVMHE ALHNHYTQKSLSLSPG (SEQ ID NO: 38) DKTHTCPPCPAPELLGGPSVFLFPPKPKDT LMISRTPEVTCVVVDVSHEDPEVKFNWYVD GVEVHNAKTKPREEQYASTYRVVSVLTVLH QDWLNGKEYKCKVSNKALPAPIEKTISKAK GQPREPQVYTLPPCRDELTKNQVSLWCLVK GFYPSDIAVEWESNGQPENNYKTPPVLDS DGSFFLYSKLTVDKSRWQQGNVFSCSVMHE ALHNHYTQKSLSLSPGGSPGVPLSLYSGPA PTSSSTKKTQLQLEYLCLDLQMILNGINNY KNPKLTAMLTAKFAMPKKATELKHLQCLEE ALKPLEEVLNLAQSKNFHLRPRDLISNINV IVLELKGSETTFMCEYADETATIVEFLNRW ITFCQSIISTLT (SEQ ID NO: 401) |

| | | | |
|---|---|---|---|
| AK498 | DNA187 | Hole: hFc(N297A)-hCD122 | DKTHTCPPCPAPELLGGPSVFLFPPKPKDT LMISRTPEVTCVVVDVSHEDPEVKFNWYVD GVEVHNAKTKPREEQYASTYRVVSVLTVLH QDWLKGKEYKCKVSNKALPAPIEKTISKAK GQPREPQVCTLPPSRDELTKNQVSLSCAVK GFYPSDIAVEWESNGQPENNYKTTPPVIDS DGSFFLVSKLTVDKSRWQQGNVFSCSVMHE ALHNHYTQKSLSLSPG (SEQ ID NO: 38) |
| AK498 | DNA586 | Knob: hFc(N297A)- [VPLSLY]- hIL2(H16E, L18C, R38A, F42A, Y45A, E62A) | APTSSSTKKTQL QLEELCLDLQMI LNGINNYKNPKL TAMLTAKFAMP KKATELKHLQCL EEALKPLEEVLN LAQSKNFHLRPR DLISNINVIVLEL KGSETTFMCEY ADTATIVEFLN RWITFCQSIISTL SGP (SEQ ID NO: 29) | DKTHTCPPCPAPELLGGPSVFLFPPKPKDT LMISRTPEVTCVVVDVSHEQPEV KFNWYVDGVEVHNAKTKPREEQYASTYRVV SVLTVLHQDVVLNGKEYKCKVSNKALPAPI EKTISKAKGQPREPQVYTLPPCRDELTKNQ VSLWCLVKGFYPSDIAVEWESNGQPEN NYKTTPPVLDSDGSFFLYSKLTVDKSRWQQ GNVFSCSVMHEALNHHYTQKSLSLSPGGSP GVPLSLYSGPAPTSSSTKKTQLQLEELCLD LQMLNGINNYKNPKLTAMLTAKFAMPKKA TELKHLQCLEEALKPLEEVLNLAQSKNFHL RPRDLISNINVIVLELKGSETTMCEYADE TATIVEFLNRWITFCQSIISTLT (SEQ ID NO: 402) |
| AK499 | DNA187 | Hole: hFc(N297A)-hCD122 | | DKTHTCPPCPAPELLGGPSVFLFPPKPKDT LMISRTPEVTCVVVDVSHEDPEVKFNWYVD GVEVHNAKTKPREEQYASTYRVVSVLTVLH QDWLKGKEYKCKVSNKALPAPIEKTISKAK GQPREPQVCTLPPSRDELTKNQVSLSCAVK GFYPSDIAVEWESNGQPENNYKTTPPVIDS DGSFFLVSKLTVDKSRWQQGNVFSCSVMHE ALHNHYTQKSLSLSPG (SEQ ID NO: 38) |
| AK499 | DNA587 | Knob: hFc(N297A)- [VPLSLY]- hIL2(L18C, D20L, R38A, F42A, Y45A, E62A) | APTSSSTKKTQL QLEHLCLLLQMI LNGINNYKNPKL TAMLTAKFAMP KKATELKHLQCL EEALKPLEEVLN LAQSKNFHLRPR DLISNINVIVLEL KGSETTFMCEY ADTATIVEFLN RWITFCQSIISTL T SGP (SEQ ID NO: 29) | DKTHTCPPCPAPELLGGPSVFLFPPKPKDT LMISRTPEVTCVVVDVSHEDPEVKFNWYVD GVEVHNAKTKPREEQYASTYRVVSVLTVLH QPWLNGKEYCKVSNKALPAPIEKTISKAK GQPREPQVTLPPCRDELTKMQVSLWCLVK GFYPSDIAVEWESMGQPENNYKTTPPVLDS DGSFFLYSKLTVDKSRWQQGNVFSCSVMHE ALHNHYTQKSLSLSPGGSPGVPLSLYSGPA PTSSSTKKTQLQLEHLCLLLQMILNGINNY KNPKLTAMLTAKFAMPKKATELKHLQCLEE ALKPLEEVLNLAQSKNFHLRPRDLISNINV IVLELKGSETTFMCBYADETATIVEFLNRW ITFCQSIISTLT (SEQ ID NO: 403) |
| AK500 | DNA187 | Hole: hFc(N297A)-hCD122 | | DKTHTCPPCPAPELLGGPSVFLFPPKPKDT LMISRTPEVTCVVVDVSHEDPEVKFNWYVD GVEVHNAKTKPREEQYASTYRVVSVLTVLH QDWLKGKEYKCKVSNKALPAPIEKTISKAK |

| | | | -continued | |
|---|---|---|---|---|
| AK500 | DNA588 | Knob: hFc(N297A)-[VPLSLY]-hIL2(H16Y, L18C, D20L, R38A, F42A, Y45A, E62A) | APTSSSTKKTQL QLEYLCLLLQMI LNGINNYKNPKL TAMLTAKFAMP KKATELKHLQCL EEALKPLEEVLN LAQSKNFHLRPR DLISNINVIVLEL KGSETTFMCEY ADETATIVEFLN RWITFCQSIISTL T (SEQ ID NO: 352) | GQPREPQVCTLPPSRDELTKNQVSLSCAVK GFYPSDIAVEWESNGQPENNYKTTPPVIDS DGSFFLVSKLTVDKSRWQQGNVFSCSVMHE ALHNHYTQKSLSLSPG (SEQ ID NO: 38) |
| AK501 | DNA187 | Hole: hFc(N297A)-hCD122 | SGP (SEQ ID NO: 29) | DKTHTCPPCPAPELLGGPSVFLFPPKPKDT LMISRTPEVTCVVVDVSHEDPEVKFNWYVD GVEVHNAICTKPREEQYASTYRVVSVLTVL HQDWLNGKEYKCKVSNKALPAPIEKTISKA KGQPREPQVYTLPPCRDELTKNQVSLWCLV KGFYPSDIAVEWESNGQPENNYKTTPPVLD SDGSFFLY SKLTVDKSRWQQGNVFSCSVMHEALHNHYT QKSLSLPGGSPGVPLSLYSGPAPTSSSTK KTQLQIEYLCLLLQMILNGINNYKNPKLTA MLTAKFAMPKKATELKHLQCLEEEALKPLEE VLNLAQSKNFHLRPRDLISNINVIVLELKG SETTFMCEYADETATIVEFLNRWITFCQSI ISTLT (SEQ ID NO: 404) |
| AK501 | DNA187 | Hole: hFc(N297A)-hCD122 | SGP (SEQ ID NO: 29) | DKTHTCPPCPAPELLGGPSVFLFPPKPKDT LMISRTPEVTCVVVDVSHEDPEVKFNWYVD GVEVHNAKTKPREEQYASTYRVVSVLTVLH QDWLKGKEYKCKVSNKALPAPIEKTISKAK GQPREPQVCTLPPSRDELTKNQVSLSCAVK GFYPSDIAVEWESNGQPENNYKTTPPVIDS DGSFFLVSKLTVDKSRWQQGNVFSCSVMHE ALHNHYTQKSLSLSPG (SEQ ID NO: 38) |
| AK501 | DNA589 | Knob: hFc(N297A)-[VPLSLY]-hIL2(H16E, L18C, D20L, R38A, F42A, Y45A, E62A) | APTSSSTKKTQL QLEELCLLLQMI LNGINNYKNPKL TAMLTAKFAMP KKATELKHLQCL EEALKPLEEVLN LAQSKNFHLRPR DLISNINVIVLEL KGSETTFMCEY ADETATIVEFLN | DKTHTCPPCPAPELLGGPSVFLFPPKPKDT LMISRTPEVTCVVVDVSHEDPEVKFNWDG VEVHNAKTKPREEQYASTYRVVSVLTVLHQ DWLNGKEVCKVSNKALPAPIFKTISKAKG QPRPPQVYTLPPCRDELTKNQVSIAVCLVK GFYPSDIAVEWESNGQPENNYKTTPPVLDS DGSFFLYSKLTVDKSRWQQGNVFSCSVMHE ALHNHYTQKSLSLSPGGSPGVPLSLYSGPA PTSSSTKKTQLQLEELCLLLQMILNGINNY KNPKLT |

| | | | |
|---|---|---|---|
| AK502 | DNA543 | Knob: hFc(N297A)-[VPLSLY]-hCD122 | RWITFCQSIISTLT (SEQ ID NO: 353)<br><br>AVNGTSQFTCF YNSRANISCVW SQDGALQDTSC QVHAWPDRRR WNQTCELLPVS QASWACNLILG APDSQKLTTVDI VTLRVLCREGVR WRVMAIQDFK PFENLRLMAPIS LQVVHVETHRC NISWEISQASHY FERHLEFEARTL SPGHTWEEAPL LLIKQKQEWICL ETLTPDTQYEFQ VRVKPLQGEFTT WSPWSQPLAFR TKPAALGKD (SEQ ID NO: 4) | AMLTAKFAMPKKATELKHLQCLEEALKPLE EVLNLAQSKNFHLRPRDLISNINIVLELK GSETTFMCEYADETATIVEFLNRWITFCQS IISTLT (SEQ ID NO: 405)<br><br>DKTHTCPPCPAPELLGGPSVFLFPPKPKDTL MISRTPEVTCVVVDVSHEDPEVKFNWDGV EVHNAKTKPREEQYASTYRVVSVLMLHQDW LNGKEYKCKVSNKALPAPIEKTISKAKGQP REPQVCTLPPSRDELTKNQVSLSCAVKGFY PSDIAVEMESNGQPENNYKTTPPVLDSDGS FFLVSKLTVDKSRWQQGNVFSCSVMHEALH NHYTQKSLSLSPGGPPSGGSSPGVPLSLYGS QGGAVNGTSQFTCFYNSRANISCVWSQDGA LQDTSCQVHAWPDRRRWNQTCELLPVSQAS WACNLILGAPDSQKLTTVDIVTLRVLCREG VRWRVMAIQDFKPFENLRLMAPISLQVVHVE THRCNISWEISQASHYFERHLEFEARTISP GHTWEEAPLLLIKQKQEWICLETITPDTQYE FQVRVKPLQGEFTTWSPWSQPLAFRTKPAA LGKD (SEQ ID NO: 42) |
| AK502 | DNA577 | Knob: hFc(N297, I253A)-hIL2 (R38A, F42A, Y45A, E62A, C125A) | | DKTHTCPPCPAPELLGGPSVFLFPPKPKDT LMASRTPEVTCVVVDVSHEDPEVKFNWYVD GVEVHNAKTKPREEQYASTYRVVSVLTVLH QDWLNGKEYKCKVSNKAIPAPIEKTISKAK GQPREPQVVTLPPCRDELTKNQVSLWCLVK GFYPSDIAVEWESNGQPENNYKTTPPVLDS DGSFFLYSKLTVDKSRWQQGNVFSCSVMHE ALHNHYTQKSLSLSPGGSSPPGGGSSGGG SGPAPTSSSTKKTQLQLEHLLLDLQMILNG INNYKNPKLTAMLTAKFAMPKKATELKHLQ CLEEALKPLEEVLNIAQSKNFHLRPRDIIS NINIVLELKGSETTFMCEYADETATIVEF LNRWITFAQSIISTLT (SEQ ID NO: 393) |
| AK503 | DNA255 | Knob: hFc (N297A)-hIL2 (R38A, F42A, Y45A, E62A, | | DKTHTCPPCPAPELLGGPSVFLFPPKPKDT LMISRTPEVTCVVVDVSHEDPEVKFNWYVD GVEVHNAKTKPREEQYASTYRVVSVLTVLH QDWLNGKEYKCKVSNKALPAPIEKTISKAK GQPREPQVVTLPPCRDELTKNQVSLWCLVK GFYPSDIAVEWESMGQPENNYKTTPPVLDS DGSFFLYSKLTVDKSRWQQGNVFSCSVMHE ALHNHYTQKSLSLSPGGSSPPGGGSSGGG |

| | | -continued |
|---|---|---|
| AK503 | C125A) | SGPAPTSSSTKKTQLQLEHLLLDLQMILNG<br>INNYKNPKLTAMLTAKFAMPKKATELKHLQ<br>CLEEALKPLEEVLNLAQSKNFHLRPRDLISN<br>INVIVLELKGSETTFMCEYADETATIVEFL<br>NRWITFAQSIISTLT<br>(SEQ ID NO: 51) |
| DNA506 | | DKTHTCPPCPAPELLGGPSVFLFPPKPKDTL<br>MISRTPEVTCVVVDVSHEDPEVKFNWYVDG<br>VEVHNAKTKPREEQYASTYRVVSVLTVLHQ<br>DWLNGKEYKCKVSNKALPAPIEKTISKAKG<br>QPREPQVCTLPPSRDELTKNQVSLSCAVKG<br>FYPSDIAVEWESMGQPENNYKTTPPVLDSD<br>GSFFLVSKLTVDKSRWQQGNVFSCSVMHEA<br>LHNHYTQKSLSLSPGGPSGSSPRAAAVKS<br>PSGGGAVNGTSQFTCFYNSRANISCVLVSQ<br>OGALQDTSCQVHAWPDRRRWNQTCELLPVS<br>QASWACNLILGAPDSQKLTTVDIVTLRVLC<br>REGVRWRVMAIQDFKPFENLRLMAPISLQV<br>VHVTHRCNISWEISQASHYFERHLEFEAR<br>TLSPGHTWEEAPLLTLKQKQEWICLETLTP<br>DTQYEFQVRVKPLQGEFITWSPWSQPLAFR<br>TKPAALGKD (SEQ ID NO: 409) |
| AK504 | AVNGTSQFTCF<br>YNSRANISCVW<br>SQDGALQDTSC<br>QVHAWPDRRR<br>WNQTCELLPVS<br>QASWACNLILG<br>APDSQKLTTVDI<br>VTLRVLCREGVR<br>WRVMAIQDFK<br>PFENLRLMAPIS<br>LQVVHVETHRC<br>NISWEISQASHY<br>FERHLEFEARTL<br>SPGHTWEEAPL<br>LTLKQKQEWICL<br>ETLTPDTQYEFQ<br>VRVKPLQGEFTT<br>WSPWSQPLAFR<br>TKPAALGKD<br>(SEQ ID NO: 4) | |
| DNA603 | Hole:<br>hFcIgG4-<br>hCD122 | ESKYGPPCPPCPAPEFLGGPSVFLFPPKPK<br>DTLMISRTPEVTCVVVDVSQEDPEVQFNWY<br>VDGVEVHNAKTKPREEQFNSTYRVVSVLTV<br>LHQDWLNGKEYKCKVSNKGLPSSIEKTISK<br>AKGQPREPQVCTLPPSQEEMTKNQVSLSCA<br>VKGFYPSDIAVEWESNGQPENNYKTTPPVL<br>DSDGSFFLYSRLTVDKSRWQEGNVFSCSVM<br>HEALHNHYTQKSLSLSL<br>GPGSGSAVNGTSQFTCFYNSRANISCVWSQ<br>DGALQDTSCQVHAWPDRRRWNQTCELLPVS<br>QASWACNLILGAPDSQKLTTVDIVTLRVLC<br>REGVRWRVMAIQDFKPFENLRLMAPISLQW<br>HVETHRCNISW<br>EISQASHYFERHLEFEARTLSPGHTWEEAP<br>LLTLKQKQEWICLETLTPDTQYEFQVRVKP<br>LQGEFTTWSPWSQPLAFRTKPAALGKD<br>(SEQ ID NO: 406) |
| AK504 | Knob:<br>hFcIgG4-hIL2-<br>[VPLSLY]-<br>hIL2(R38A,<br>F42A, Y45A,<br>E62A, C125A) | SGP<br>(SEQ ID<br>NO: 29) | APTSSSTKKTQL<br>QLEHLLDLQMI<br>LNGINNYKNPKL<br>TAMLTAKFAMP<br>KKATELKHLQCL<br>EEALKPLEEVLN<br>LAQSKNFHLRPR | ESKYGPPCPPCPAPEFLGGPSVFLFPPKPK<br>DTLMISRTPEVTCVVVDVSQEDPEVQFNWY<br>VDGVEVHNAKTKPREEQFNSTYRVVSVLTV<br>LHQDWLMGKEYKCKVSNKGLPSSIEKTISK<br>AKGQPREPQVTLPPCQEEMTKNQVSLWCL<br>VKGFYPSDIAVEWESMGQPENNYKTTPPVL<br>DSDGSFFLYSRLTVDKSRWQEGNVFSCSVM |

| | | -continued |
|---|---|---|
| AK504 | | DLISNINVIVL ELKGSETTFMC EYADETATIVEF LNRWITFAQSII STLT (SEQ ID NO: 3) | HEALHNHYTQKSLSLSLGGSPGVPLSLYSG PAPTSSSTKKTQLQLEHLLLDLQMILNGIN NYKNPKLTAMLTAKFAMPKKATELKHLQCL EEALKPLEEVLNLAQSKNFHLRPRDLISNI NVIVLELKGSETTFMCEYAOETATIVEFLN RWITFAQSIISTLT (SEQ ID NO: 408) |
| AK504 | DNA603 | Hole: hFcIgG4-hCD122 | ESKYGPPCPPCPAPEFLGGPSVFLFPPKPK DTLMISRTPEVTCVVVDVSQEDPEVQFNWY VDGVEVHNAKTKPREEQFNSTYRVVSVLTV LHQDWLNGKEYKCKVSNKGLPSSIEKTISK AKGQPREPQVCTLPPSQEEMTKNQVSLSCA VKGFYPSDIAVEWESNGQPENNYKTTPPVL DSDGSFFLYSRLTVDKSRWQEGNVFSCSVM HEALHNHYTQKSLSLSL GPGSGSAVNGTSQFTCFYNSRANISCVWSQ DGALQDTSCQVHAWPDRRRWNQTCELLPVS QASWACNLILGAPDSQKLTTVDIVTLRVLC REGVRWRVMAIQDFKPFENLRLMAPISLQW HVETHRCNISW EISQASHYPERHLEFEARTLSPGHTWERAP LLTLKQKQEWICLETLTPDTQYEFQVRVKP LQGEFTTWSPWSQPLAFRTKPAALGKD (SEQ ID NO: 406) |
| AK504 | DNA604 | Knob: IgG4 hFc- hIL2 (R38A, F42A, Y45A, E62A, C125A) | ESKYGPPCPPCPAPEFLGGPSVFLFPPKPK DTLMISRTPEVTCVVVDVSQEDPEVQFNWY VDGVEVHNAKTKPREEQFNSTYRVVSVLTV LHQDWLNGKEYKCKVSNKGLPSSIEKTISK AKGQPREPQVYTLPPCQEEMTKNQVSLWCL VKGFYPSDIAVEWESNGQPENNYKTTPPVL DSDGSFFLYSRLTVDKSRWQEGNVFSCSVM HEALHNHYTQKSLSLSLGGGSSPPGGGSSG GGSGPAPTSSSTKKTQLQLEHLLLDLQMIL NGINNYKNPKLTAMLTAKFAMPKKATELKH LQCLEEALKPLEEVLNLAQSKNFHLRPRDL ISNINIVLELKGSETTFMCEYADETATIV EFLNRWITFAQSIISTLT (SEQ ID NO: 407) |
| AK508 | DNA577 | Knob: hFc (N297, I253A)- hIL2 (R38A, F42A, Y45A, E62A, C125A) | DKTHTCPPCPAPELLGGPSVFLFPPKPKDT LMASRTPEVTCVVVDVSHEDPEVKFNWYVD GVEVHNAKTKPREEQYASTYRVVSVLTVLH QDWLNGKEYKCKVSNKAIPAPIEKTISKAK GQPREPQVVTLPPCRDELTKNQVSLWCLVK GFYPSDIAVEWESNGQPENNYKTTPPVLDS DGSFFLYSKLITVDKSRWQQGNVFSCSVMHE ALHNHYTQKSLSLSPGGGSSPPGGSSGGG SGPAPTSSSTKKTQLQLEHLLLDLQMILNG |

| | | | |
|---|---|---|---|
| AK508 | DNA609 | Hole: hFc(N297A, I253A)-[VPLSLY]-hCD122 | GSGGG (SEQ ID NO: 31) | INNYKNPKLTAMLTAKFAMPKKATELKHLQ CLEEALKPLEEVLNIAQSKNFHLRPRDIIS NINVIVLELKGSETTFMCEYADETATIVEF LNRWITFAQSIISTLT (SEQ ID NO: 393) DKTHTCPPCPAPELLGGPSVFLFPPKPKDTL MASRTPEVTCVVVDVSHEDPEVKFNWWDGV EVHNAKTKPREEQYASTYRVVSVLTVLHQD WLNGKEYKCKVSNKALPAPIEKTISKAKG PREPQVCTLPPSRDELTKNQVSLSCAVKGF YPSDIAVEVVESNGQPENNYKTTPPVLDSD 6SFFLVSKLTVDKSRWQQGNVFSCSVMHEAL HNHYTQKSLSLSPGGPPSGSSPGVPLSLYG SGGGAVNGTSQFTCFYNSRANISCVWSQDG ALQDTSCQVHAWPDRRRWNQTC ELLPVSQASWACNLILGAPDSQKLTTVDIV TLRVLCREGVRWRVMAIQDFKPFENLRLMA PISLQVVHETHRCNISWEISQASHYFERH LEFEARTLSPGHTWEEAPLLTLKQKQEWIC LETLTPDTQYEFQVRVKPLQGEFTTWSPWS QPLAFRTKPAALGKD (SEQ ID NO: 411) |
| AK509 | DNA575 | Hole: hFc(N297A, I253A)-hCD122 | | DKTHTCPPCPAPELLGGPSVFLFPPKPKDT LMASRTPEVTCVVVDVSHEDPEVKFNWYVD GVEVHNAIOKPREEQYASTYRVVSVLTVLH QDWLNGKEYKCKVSNKALPAPIEKTISKAK GQPREPQVCTLPPSRDELTKNQVSLSCAVK GFYPSDIAVEWESNGQPENNYKTTPPVLDS DGSFFLVSKLTVDKSRWQQGNVFSCSVMHE ALHNHYTQKSLSLSPGPGSGSAVNGTSQFT CFYNSRANISCVWSQDGALQDTSCQVHAWP DRRRMNQTCELLPVSQASWACNLILGAPDS QKLTTVDIVTLRVLCREGVRWRVMAIQPFK PFENLRIMAPISLQVVHVETHRCNISWEIS QASHYFERHLEFEARTLSPGHTWEEAPLLT LKQKQEWICLETLTPDTQYEFQVRVKPLQG EFTTVSPVVSQPLAFRTKPAALGKD (SEQ ID NO: 43) |
| AK509 | DNA623 | Knob: hFc(N297, I253A)-[MPYDLYHP] hIL2 (R38A, F42A, Y45A, E62A, | SGP (SEQ ID NO: 29) | DKTHTCPPCPAPELLGGPSVFLFPPKPKDTL MASRTPEVTCVVVDVSHEDPEVKFNWYVDG VEVHNAKTKPREEQYASTYRVVSVLTVLHQ PWLNGKEYCKVSNKALPAPIEKTISKAKG QPREEQVYTLPPCRDELTKNQVSLMCLVKG FYPSDIAVEWESNGQPENNYKTTPPVLDSD GSFFLYSKLTVDKSRWQQGNVFSCSVMHEA LHNHYTOKSLSLSPGGGSSPPMPYDLYHPS GPAPTSSSTKKTQLQLEHLLLDLQMILNGI APTSSSTKKTQL QLEHLLLDLQMI LNGINNYKNPKL TAMLTAKFAMP KKATELKHLQL EEALKPLEEVLN LAQSKNFHLRPR DLISNINIVL ELKGSETTFMC |

-continued

| | | | | |
|---|---|---|---|---|
| AK510 | | C125A) | EYADETATIVEF LNRWITFAQSII STLT (SEQ ID NO: 3) | NNYKNPKLTAMLTAKFAMPKKATELKHLQC LEEEALXPLEEVLNLIAQSKNFHLRPRDLISN INVIVLELKGSETTFMCEYADETATIVEFL NRWITFAQSIISTLT (SEQ ID NO: 415) |
| AK510 | DNA577 | Knob: hFc(N297A, I253A)-hIL2 (R38A, F42A, Y45A, E62A, C125A) | | DKTHTCPPCPAPELLGGPSVFLFPPKPKDT LMASRTPEVTCVVVDVSHEDPEVKFNWYVD GVEVHNAKTKPREEQYASTYRVVSVLTVLH QDWLNGKEYKCKVSNKAIPAPIEKTISKAK GQPREPQVVTLPPCRDELTKNQVSLWCLVK GFYPSDIAVEWESNGQPENNYKTTPPVLDS DGSFFLYSKLTVDKSRWQQGNVFSCSVMHE ALHNHYTQKSLSLSPGGGSSPPGGGSSGGG SGPAPTSSSTKKTQLQLEHLLLDLQMILNG INNYKNPKLTAMLTAKFAMPKKATELKHLQ CLEEEALKPLEEVLNIIAQSKNFHLRPRDIIS NINVIVLELKGSETTFMCEYADETATIVEF LNRWITFAQSIISTLT (SEQ ID NO: 393) |
| AK510 | DNA608 | Hole: hFc(N297A, I253A)-[MPYDLYHP]-hCD122 | AVNGTSQPTCF YNSRANISCVW SQDGALQDTSC QVHAWPDRRR WNQTCELLPVS QASWACNLILG APDSQKLTTVDI VTLRVLCREGVR WRVMAIQDFK PFENLRLMAPIS LQVVHVETHRC NISWEISQASHY FERHLEFEARTL SPGHTWEEAPL LTLKQKQEWICL ETLTPDTQYEFQ VRVKPLQGEFTT WSPWSQPLAFR TKPAALGKD (SEQ ID NO: 4) | DKTHTCPPCPAPELLGGPSVFLFPPKPKDTL MASRTPEVTCVVVDVSHEDPEVKFNWYVDG VEVHNAKTKPREEQYASTYRVVSVLTVLHQ DWLNGKEYKCKVSNKALPAPIEKTISKAKG OPREPQVCTLPPSRDELTKNQVSLSCAVKG FYPSDIAVEWESNGQPENNYKTTPPVLDSD GSFFLVSKLTVDKSRWQQGNVFSCSVMHEA LHNHYTQKSLSLSPGGPPSGSSPMPYDLYH PSGGGAVNGTSQFTCFYNSRANISCVWSQD GALQDTSCQVHAWPDRRRWNQTCELLPVSQ ASWACNLILGAPDSQKLTTVDIVTLRVLCRE GVRWRVMAIQDFKPFENLRLMAPISLQVVH VETHRCNISWEISQASHYFERHLEFEARTL SPGHTWEEAPLLTLKQKQEWICLETLTPDT QYEFQVRVKPLQGEFTTWSPWSQPLAFRTK PAALGKD (SEQ ID NO: 410) |
| AK511 | DNA604 | Knob: IgG4 hFc-hIL2(R38A, F42A, Y45A, E62A, C125A) | | ESKYGPPCPPCPAPEFLGGPSVFLFPPKPK DTLMISRTPEVTCVVVDVSQEDPEVQFNWY VDGVEVHNAKTKPREEQFNSTYRVVSVLTV LHQDWLNGKEYKCKVSNKGLPSSIEKTISK AKGQPREPQVYTLPPCQEEMTKNQVSLWCL VKGFYPSDIAVEWESNGQPENNYKTTPPVL DSDGSFFLYSRLTVDKSRWQEGNVFSCSVM HEALHNHYTQKSLSLSLGGGSSPPGGGSSG GGSGPAPTSSSTKKTQLQLEHLLLDLQMIL NGINNYKNPKLTAMLTAKFAMPKKATELKH LQCLEEEALKPLEEVLNLAQSKNFHLRPRDL |

-continued

| | | | |
|---|---|---|---|
| AK511 | DNA621 | Hole: hFcIgG4-[VPLSLY]-hCD122 | AVNGTSQFTCF YNSRANISCVW SQD6ALQDTSC QVHAWPDRRR WNQTCELLPVS QASWACNLILG APDSQKLTTVDI VTLRVLCREGVR WRVMAIQDFK PFENLRLMAPIS LQVHVETHRC NISWEISQASHY FERRHLEFEARTL SPGHTWEEAPL LTLKQKQEWICL ETLTPDTQYEFQ VRVKPLQGEFTT WSPWSQPLAFR TKPAALGKD (SEQ ID NO: 4) | ISNINVIVLELKGSETTMCEYADETATIV EFLNRWITFAQSIISTLT (SEQ ID NO: 407) |
| | | GSGGG (SEQ ID NO: 31) | |
| AK512 | DNA577 | Knob: hFc(N297A, I253A)-hIL2 (R38A, F42A, Y45A, E62A, C125A) | | DKTHTCPPCPAPELLGGPSVFLFPPKPKDT LMASRTPEVTCVVVDVSHEDPEVKFNWYVD GVEVHNAKTKPREEQYASTYRVVSVLTVLH QDWLNGKEYKCKVSNKAIPAPIEKTISKAK GQPREPQVVTLPPCRDELTKNQVSLWCLVK GFYPSDIAVEWESNGQPENNYKTTPPVLDS DGSFFLYSKLTVDKSRWQQGNVFSCSVMHE ALHNHYTQKSLSLSPGGGSSPPGGGSSGGG SGPAPTSSSTKKTQLQLEHLLLDLQMILNG INNYKNPKLTAMLTAKFAMPKKATELKHLQ CLEEALKPLEEVLNIAQSKNFHLRPRDIIS NINVIVLELKGSETTFMCYADETATIVEF LNRWITFAQSIISTLT (SEQ ID NO: 393) |
| AK512 | DNA625 | Hole: hFc(N297A, I253A) | | DKTHTCPPCPAPELLGGPSVFLFPPKPKDTL MASRTPEVTCVVVDVSHEDPEVKFNWYVDG VEVHNAKTKPREEQYASTYRVVSVLTVLHQ PWLNGKEYCCKVSNKALPAPIEKTISKAKG QPREPQVCTLPPSRDELTKNQVSLSCAVKG FYPSDIAVEWESNGQPENNYKTTPPVLDSD GSFFLVSKLTVDKSRWQQGNVFSCCSVMHEA LHNHYTQKSLSLSPG (SEQ ID NO: 10) |
| AK513 | DNA504 | Knob: Ig64 hFc-hIL2(R38A, | | ESKYGPPCPPCPAPEFLGGPSVFLFPPKPK DTLMISRTPEVTCVVVDVSQEDPEVQFNWY VDGVEVHNAKTKPREEQFNSTYRVVSVLTV |

| | | |
|---|---|---|
| AK513 | DNA626 | F42A, Y45A, E62A, C125A) | LHQDWLNGKEYKCKVSNKGLPSSIEKTISK AKGQPREPQVYTLPPCQEEMTKNQVSLWCL VKGFYPSDIAVEWESNGQPENNYKTTPPVL DSDGSFFLYSRLTVDKSRMQEGNVFSCSVM HEALHNHYTQKSLSLSLGGGSSPPGGGSSG GGSGPAPTSSSTKKTQLQLEHLLLDLQMIL NGINNYKNPKLTAMLTAKFAMPKKATELKH LQCLEEALKPLEEVLNLAQSKNFHLRPRDL ISNINIVLELKGSETTFMCEYADETATIV EFLNRWITFAQSIISTLT (SEQ ID NO: 407) |
| AK526 | DNA626 | Hole: HFcIgG4 | ESKYGPPCPPCPAPEFLGGPSVFLFPPKPK DTLMISRTPEVTCVVVDVSQEDPEVQFNWY VDGVEVHNAKTKPREEQFNSTYRVVSVLTV LHQDWLNGKEYKCKVSNKGLPSSIEKTISK AKGQPREPQVCTLPPSQEEMTKNQVSLSCA VKGFYPSDIAVEWESNGQPENNYKTTPPVL DSDGSFFLYSRLTVDKSRMQEGNVFSCSVM HEALHNHYTQKSLSLSLGPG (SEQ ID NO: 298) |
| AK526 | DNA670 | Knob: hFc-hIL2 (R38A, F42A, Y45A, E62A, C125A) | DKTHTCPPCPAPELLGGPSVFLFPPKPKDT LMISRTPEVTCVVDVSHEDPEVKFNWYVDG VEVHNAKTKPREEQYNSTYRWSVLTVLHQD WLNGKEYKCKVSNKALPAPIEKTISKAKGQ PREPQWTLPPCRDELTKNQVSLWCLVKGFY PSDIAVEWESNGQPENNYKTTPPVLDSDGS FFLYSKLTVDKSRMQQGNVFSCSVMHEALH NHYTQKSLSLSPGGGSSPPGGGSSGGGSGP APTSSSTKKTQLQLEHLLLDLQMILNGINN YKNPKLTAMLTAKFAMPKKATELKHLQCLE EALKPLEEVLNLAQSKNFHLRPRDLISNIN VIVLELKGSETTFMCEYADETATIVEFLNR WITFAQSIISTLT (SEQ ID NO: 423) |
| AK526 | DNA672 | Hole: hFc-[VPLSLY]-hCD122 | DKTHTCPPCPAPELLGGPSVFIFPPKPKDTL MISRTPEVTCVVVDVSHEDPEVKFNWYVDG VEVHNAKTKPREEQYNSTYRVVSVLTVLHQ DWLNGKEYKCKVSNKALPAPIEKTISKAKG QPREPQVCTLPPSRDELTKNQVSLSCAVKG FYPSDIAVEWESNGQPENNYKTTPPVLDSD GSFFLVSKLTVDKSRWQQGNVFSCSVMHEA LHNHYTQKSLSLSPGGPSGSSPGVPLSLY GSGGAVNGTSQFTCFYNSRANISCVWSQD GALQDTSCQVHAWPDRRRMNQTCELLPVSQ ASWACNLILGAPDSQKLITVDIVTIRVLCR EGVRMRVMAIQDFKPFENLRLMAPISLQVV HVETHRCNISWEISQASHYFERHLEFEART LSPGHTWEEAPLITIKQKQEWSCIETITPD TQYEFQVRVKPLQGEFTTWSPWSQPLAFRT KPAALGKD (SEQ ID NO: 425) AVNGTSQFTCF YNSRANISCVW SQD6ALQDTSC QVHAWPDRRR WNQTCELLPVS QASWACNLILG APDSQKLITTVDI VTLRVLCREGVR WRVMAIQDFK PFENLRLMAPIS LQVVHETHRC NISWEISQASHY FERHLEFEARTL SPGHTWEEAPL LITLKQKQEMICL ETLTPDTQYEFQ GSGGG (SEQ ID NO: 31) |

| | | | |
|---|---|---|---|
| AK530 | Knob:<br>hFc(N297A)-<br>hIL2(R38A,<br>F42A, Y45A,<br>E62A; C125A) | DNA255 | VRVKPLQGEFTT<br>WSPWSQPLAFR<br>TKPAALGKD<br>(SEQ ID NO: 4) | DKTHTCPPCPAPELLGGPSVFLFPPKPKDT<br>LMISRTPEVTCVVVDVSHEDPEVKFNWYVD<br>GVEVHNAKTKPREEQYASTYRVVSVLTVLH<br>QDWLNGKEYKCKVSNKALPAPIEKTISKAK<br>GQPREPQVYTLPPCRDELTKNQVSLWCLVK<br>GFYPSDIAVEWESMGQPENNYKTTPPVLDS<br>DGSFFLYSKLTVDKSRWQQGNVFSCSVMHE<br>ALHNHYTQKSLSLSPGGGSSPPGGGSSGGG<br>SGPAPTSSSTKKTQLQLEHLLLDLQMILNG<br>INNYKNPKLTAMLTAKFAMPKKATELKHLQ<br>CLEEALKPLEEVLNLAQSKNFHLRPRDLISN<br>INVIVLELKGSETTFMCEYADETATIVEFL<br>NRWITFAQSIISTLT<br>(SEQ ID NO: 51) |
| AK530 | Hole:<br>hFc(N297A)-<br>[MPYDLYHP]-<br>hCD122<br>(C122S,<br>C168S) | DNA612 | AVNGTSQFTCF<br>YNSRANISCVW<br>SQDGALQDTSC<br>QVHAWPDRRR<br>WNQTCELLPVS<br>QASWACNLILG<br>APDSQKLTTVDI<br>VTLRVLCREGVR<br>WRVMAIQDRC<br>PFENLRLMAPIS<br>LQMHVETHRS<br>NISWEISQASHY<br>FERHLEFEARTL<br>SPGHTWEEAPL<br>LTILKQKQEWISL<br>ETLTPDTQYEFQ<br>VRVKPLQGEFTT<br>WSPWSQPLAFR<br>TKPAALGKD<br>(SEQ ID NO: 5) | SGGG<br>(SEQ ID<br>NO: 30) | DKTHTCPPCPAPELLGGPSVFLFPPKPKDTL<br>MISRTPEVTCVVVDVSHEDPEVKFNWYVDG<br>VEVHNAKTKPREEQYASTYRVVSVLTVLHQ<br>DWLNGKEYKCKVSNKALPAPIEKTISKAKG<br>QPREPQVCTLPPSRDELTKNQVSLSCAVKG<br>FYPSQIAVEWESNGQPENNYKTTPPVLDSD<br>GSFFLVSKLTVDKSRWQQGNVFSCSVMHEA<br>LHNHYTQKSLSLSPGGPPSGSSPMPYDLYH<br>PSGGGAVNGTSQFTCFYNSRANISCVWSQD<br>GALQDTSCQVHAWPDRRRWNQTCELLPVSQ<br>ASWACIMLJILGAPDSQKLTTVDIVTLRVLC<br>REGVRWRVMAIQDFKPFENLRLMAPISLQV<br>VHVETHRSNISWEISQASHYFERHLEFEAR<br>TISPGHTWEEAPLLTIKQKEWISLETLTP<br>DTQYEFQVRVKPLQGEFTTWSPWSQPLAFR<br>TKPAALGKD (SEQ ID NO: 40) |
| AK531 | Knob:<br>hFc(N297A)-<br>hIL2(R38A,<br>F42A, Y45A,<br>E62A, C125A) | DNA255 | | DKTHTCPPCPAPELLGGPSVFLFPPKPKDT<br>LMISRTPEVTCVVVDVSHEDPEVKFNWYVD<br>GVEVHNAKTKPREEQYASTYRVVSVLTVLH<br>QDWLNGKEYKCKVSNKALPAPIEKTISKAK<br>GQPREPQVYTLPPCRDELTKNQVSLWCLVK<br>GFYPSDIAVEWESMGQPENNYKTTPPVLDS<br>DGSFFLYSKLTVDKSRWQQGNVFSCSVMHE<br>ALHNHYTQKSLSLSPGGGSSPPGGGSSGGG<br>SGPAPTSSSTKKTQLQLEHLLLDLQMILNG |

-continued

| | | | |
|---|---|---|---|
| AK531 | ANA614 | | INNYKNPKLTAMLTAKFAMPKKATELKHLQ CLEEALKPLEEVLNLAQSKNFHLRPRDLISN INVIVLELKGSETTFMCEYADETATIVEFL NRWITFAQSIISTLT (SEQ ID NO: 51) |
| AK532 | Hole: hFc(N297A)-[DSGGMLT]-hCD122 (C122S, C168S) | AVNGTSQFTCF YNSRANISCVW SQDGALQDTSC QVHAWPDRRR WNQTCELLPVS QASWACNLILG APDSQKLTTVDI VTLRVLCREGVR WRVMAIQDRC PFENLRLMAPIS LQWHVETHRS NISWEISQASHY FERHLEFEARTL SPGHTWEEAPL LTLKQKQEWISL ETLTPDTQYEFQ VRVKPLQGEFTT WSPWSQPLAFR TKPAALGKD (SEQ ID NO: 5) | DKTHTCPPCPAPELLGGPSVFLFPPKPKDT LMISRTPEVTCVVVDVSHEDPEVKFNWYVD GVEVHNAKTKPREEQYASTYRVVSVLTVLH QDWLNGKEYKCKVSNKALPAPIEKTISKAK GQPREPQVCTLPPSRDELTKNQVSLSCAVK GFYPSQIAVEWESNGQPENNYKTTPPVLDS DGSFFLVSKLTVDKSRWQQGNVFSCSVMHE ALHNHYTQKSLSLSPGGPPSGSSPGDSGGF MLTSGGGAVNGTSGFTCFYNSRANISCVWS QDGALQDTSCQVHAWPDRRRMNQTCELLPV SQASWACNLILGAPDSQKLTTVDIVTLRVL CREGVRWRVMAIQDFKPFENLRLMAPISLQ VVHVETHRSNISWEISQASHYFERHLEFEA RTLSPGHTWEEAPLLTLKQKQEWISLETIT PDTQYEFQVRVKPLQGEFTTWSPWSQPLAF RTKPAALGKD (SEQ ID NO: 413) |
| AK532 | DNA669 | Hole: hFc-hCD122 | DKTHTCPPCPAPELLGGPSVFLFPPKPKDT LMISRTPEVTCVVVDVSHEDPEVKFNWYVD GVEVHNAKTKPREEQYNSTYRVVSVLTVLH QDWINGKEYKCKVSNKALPAPIEKTISKAK GQPREPQVCTLPPSRDELTKNQVSLSCAVK GFYPSDIAVEWESNGQPENNYKTTPPVLDS DGSFFLVSKLTVDKSRWQQGNVFSCSVMHE ALHNHYTQKSLSLSPGGSGSAVNGTSQFT CFYNSRANISCVWSQDGALQDTSCQVHAWP DRRRMNQTCELLPVSQASWACNLILGAPDS QKLTTVDIVTLRVLCREGVRWRVMAIQDFK PFENLRLMAPISLQWHVETHRCNISWEISQ ASHYFERHLEFEARTLSPGHTWEEAPLLTL KQKQEWICLETLTPDTQYEFQVRVKPLQGE FTTWSPWSQPLAFRTKPAALGKD (SEQ ID NO: 422) |
| | DNA561 | Knob: hFc [VPLSLY]-hIL2 (R38A, F42A, Y45A, E62A, C125A) | APTSSSTKKTQL QLEHLLLDLQMI LNGINNYKNPKL TAMLTAKFAMP KKATELKHLQCL EEALKPLEEVLN LAQSKNFHLRPR DLISNINIVLEL KGSETTFMCEY SGGG (SEQ ID NO: 30) | DKTHTCPPCPAPELLGGPSVFLFPPKPKDT IMISRTPEVTCVVVDVSHEDPEVKFNWYV DGVEVHNAKTKPREEQYNSTYRVVSV LTVLHQDWLNGKEYKCKVSNKALPAPIEKT ISKAKGQPREPQVTLPPCRDELTKNQVSL WCLVKGFYPSDIAVEWESNGQPENNYKTTP PVLCSDGSFFLYSKLTVDKSRWQQGNVFSC SVMHEALHNHYTQKSLSLSPGSSPGVPLSL YSGPAPTSSSTKKTQLQLEHLLLDLQMILN |

| name | newnames | component1 Sequence | Component2 Sequence | Component3 Sequence |
|---|---|---|---|---|
| DNA158 | Hole: hFc(N297A) | DKTHTCPPCPAPELLGGPSVFLPPPKPKDTL MISRTPEVTCVVVDVSHEDPEVKFNWYVDGV EVHNAKTKPREEQYASTYRVVSVLTVLHQDW LNGKEYKCKVSNKALPAPIEKTISKAKGQPR EPQVCTLPPSRDELTKNQVSLSCAVKGFYPS DIAVEWESNGQPENNYKTTPPVLDSGSFFL VSKLTVDKSRWQQGMVFSCSVMHEALHNHY TQKSLSLSPG (SEQ ID NO: 9) | ADETATIVEFLN RWITFAQSIISTL T (SEQ ID NO: 3) | GINNYKNPKLTAMLTAKFAMPKKATELKHL QCIEEALKPLEEVLNLAQSKNFHIRPRDLI SNINIVLELKGSETTFMCEYADETATIVE FLNRWITFAQSRSTLT (SEQ ID NO: 424) |
| DNA187 | Hole: hFc(N297A) | DKTHTCPPCPAPELLGGPSVFLPPPKPKDTL MISRTPEVTCVVVDVSHEDPEVKFNWYVDGV EVHNAKTKPREEQYASTYRVVSVLTVLHQDW LNGKEYKCKVSNKALPAPIEKTISKAKGQPR EPQVCTLPPSRDELTKNQVSLSCAVKGFYPS DIAVEWESNGQPENNYKTTPPVLDSGSFFL VSKLTVDKSRWQQGMVFSCSVMHEALHNHY TQKSLSLSPG (SEQ ID NO: 9) | PGSGS (SEQ ID NO: 14) | AVNGTSQFTCFYNSRANISCVWSQDGALQDT SCQVHAWPDRRRWNQTCELLPVSQASWACN LILGAPDSQKLTTVDIVTLRVLCREGVRWR VMAIQDFKPFENLRLMAPISLQVVHVETHR CNISWEISQASHYFERHLEFEARTLSPGHT WEEAPLLTLKQKQEWICLETLTPDTQYEFQ VRVKPLQGEFTTWSPWSQPLAFRTKPAALG KD (SEQ ID NO: 4) |
| DNA255 | Knob: hFc(N297A)- hIL2 (R38A, F42A, Y45A, E62A, C125A) | DKTHTCPPCPAPELLGGPSVFLPPK PKDTLMISRTPEVTCVVVDVSHEDP EVKFNWYVDGVEVHNAKTKPREEQY ASTYRVVSVLTVLHQDWLNGKEYKC KVSNKALPAPIEKTISKAKGQPREP QVVTLPPCRDELTKNQVSLWCLVKG FYPSDSAVEWESNGQPENNYKTTPP VIDSDGSFFLYSKITVDKSRWQQGN VFSCSVMHEALHNHYTQKSLSLSPG (SEQ ID NO: 12) | GGSSPP GGGSSG GGSGP (SEQ ID NO: 23) | APTSSSTKKTQL QLEHLLLDLQMILNGINNYKNPKL TAMLTAKFAMPKKATELKHLQCL EEALKPLEEVLNLAQSKNFHLRPR DLISNINVIVLELKGSETTFMCEY ADETATIVEFLNRWITFAQSIISTLT (SEQ ID NO: 3) |
| DNA263 | Knob: hFc(N297A)- [VPLSLY]- hIL2 (R38A, F42A, Y45A, E62A, C125A) | DKTHTCPPCPAPELLGGPSVFLPPK PKDTLMISRTPEVTCVVVDVSHEDP EVKFNWYVDGVEVHNAKTKPREEQY ASTYRVVSVLTVLHQDWLNGKEYKC KVSNKALPAPIEKTISKAKGQPREP QVVTLPPCRDELTKNQVSLWCLVKG FYPSDSAVEWESNGQPENNYKTTPP VIDSDGSFFLYSKITVDKSRWQQGN VFSCSVMHEALHNHYTQKSLSLSPG (SEQ ID NO: 12) | GSPG (SEQ ID NO: 34) | VPLSLY (SEQ ID NO: 28) |
| DNA278 | Knob: hFc(N297A)- | DKTHTCPPCPAPELLGGPSVFLPPK PKDTLMISRTPEVTCVVVDVSHEDP | GSGP (SEQ ID | DSGGFMLT (SEQ ID |

-continued

| | | | |
|---|---|---|---|
| | [DSGGFMLT] hIL2 (C125A) | EVKFNWYVDGVEVHNAKTKPREEQY ASTYRVVSVLTVLHQDWLNGKEYKC KVSNKALPAPIEKTISKAKGQPREP QVYTLPPCRDELTKNQVSLWCLVKG FYPSDSAVEWESNGQPENNYKTTPP VIDSDGSFFLYSKITVDKSRWQQGN VFSCSVMHEALHNHYTQKSLSLSPG (SEQ ID NO: 12) | NO: 33) | DSGGFMLT (SEQ ID NO: 25) |
| DNA281 | Knob: hFc(N297A)- [DSGGFMLT] hIL2 (R38A, F42A, Y45A, E62A, C125A) | DKTHTCPPCPAPELLGGPSVFLFPPK PKDTLMISRTPEVTCVVVDVSHEDP EVKFNWYVDGVEVHNAKTKPREEQY ASTYRVVSVLTVLHQDWLNGKEYKC KVSNKALPAPIEKTISKAKGQPREP QVYTLPPCRDELTKNQVSLWCLVKG FYPSDSAVEWESNGQPENNYKTTPP VIDSDGSFFLYSKITVDKSRWQQGN VFSCSVMHEALHNHYTQKSLSLSPG (SEQ ID NO: 12) | GSGP (SEQ ID NO: 33) | DSGGFMLT (SEQ ID NO: 25) |
| DNA440 | Hole: hFc(N297A)- hCD122 (C122S, C168S) | DKTHTCPPCPAPELLGGPSVFLFPPKPKDTL MISRTPEVTCVVVDVSHEDPEVKFNWYVDGV EVHNAKTKPREEQYASTYRVVSVLTVLHQDW LNGKEYKCKVSNKALPAPIEKTISKAKGQPR EPQVCTLPPSRDELTKNQVSLSCAVKGFYPS DIAVEWESNGQPENNYKTTPPVLDSDGSFFL VSKLTVDKSRWQQGMVFSCSVMHEALHNHY TQKSLSLSPG (SEQ ID NO: 9) | PGSGS (SEQ ID NO: 14) | AVNGTSQFTCFYNSRANISCVW SQDGALQDTSCQVHAWPDRRR WNQTCELLPVSQASWACNLILG APDSQKLTTVDIVTLRVLCREGVR WRVMAIQDRCPFENLRLMAPIS LQWHVETHRSNISWEISQASHY FERHLEFEARTLSPGHTWEEAPL LTLKQKQEWISLETLTPDTQYEFQ VRVKPLQGEFTTWSPWSQPLAFR TKPAALGKD (SEQ ID NO: 5) |
| DNA476 | Knob: hFc(N297A)- [NPMGSD PVNFK LLRWNG]- hIL2(F42S, E62S, C125A) | DKTHTCPPCPAPELLGGPSVFLFPPK PKDTLMISRTPEVTCVVVDVSHEDP EVKFNWYVDGVEVHNAKTKPREEQY ASTYRVVSVLTVLHQDWLNGKEYKC KVSNKALPAPIEKTISKAKGQPREP QVYTLPPCRDELTKNQVSLWCLVKG FYPSDSAVEWESNGQPENNYKTTPP VIDSDGSFFLYSKITVDKSRWQQGN VFSCSVMHEALHNHYTQKSLSLSPG (SEQ ID NO: 12) | G | NPMGSDPVNFKLLRWNG (SEQ ID NO: 325) |
| DNA477 | Knob: mFcIgG2a (LALAPG)- hIL2 (R38A, F42A, Y45A, E62A, C125A) | TIKPCPPCKCPAPNAAGGPSVFIFP PKIKDVLMISLSPIVTCVVVDVSED DPDVQISWFVNNVEVHTAQTQTHRE DYNSTLRVVSALPIQHQDWMSGKEF KCKVNNKDLGAPIERTISKPKGSVR APQVYVLPPCEEEMTKKQVTLWCMV TQFMPEDIYVEWTNNGKTELNYKNT EPVLDSQGSYFMYSKLRVEKKNWVE RNSYSCSVMHEGLHNHHTTKSFSRTP G (SEQ ID NO: 280) | GGSSPP GGGSSG GGSGP (SEQ ID NO: 23) | APTSSSTKKTQL QLEHLLDLQMILNGINNYKNPKL TAMLTAKFAMPKKATELKHLQCL EEALKPLEEVLNLAQSKNFHLRPR DLISNINVLELKGSETTFMCEY ADETATIVEFLNRWITFAQSIISTLT (SEQ ID NO: 3) |

-continued

| | | | | |
|---|---|---|---|---|
| DNA478 | Knob: mFcIgG2a (LALAPG)-[VPLSLY] hIL2 (R38A, F42A, Y45A, E62A, C125A) | TIKPCPPCKCPAPNAAGGPSVFIFP PKIKDVLMISLSPIVTCVVVDVSED DPDVQISWFVNNVEVHTAQTQTHRE DYNSTLRVVSALPIQHQDWMSGKEF KCKVNNKDLGAPIERTISKPKGSVR APQVYVLPPCEEEMTKKQVTLWCMV TQFMPEDIYVEWTNNGKTELNYKNT EPVLDSQGSYFMYSKLRVEKKNWVE RNSYSCSWHEGLHNHHTTKSFSRTP G (SEQ ID NO: 280) | GSGP (SEQ ID NO: 33) | DSGGFMLT (SEQ ID NO: 25) |
| DNA479 | Hole: mFcIgG2a (LALAPG) | TIKPCPPCKCPAPNAAGGPSVFIFP PKIKDVLMISLSPIVTCVVVDVSED DPDVQISWFVNNVEVHTAQTQTHRE DYNSTLRVVSALPIQHQDWMSGKEF KCKVNNKDLGAPIERTISKPKGSVR APQVCVLPPPEEEMTKKQVTLSCAV TDFMPEDIWEWTNNGKTELNYKNTE PVLDSDGSYFMVSKLRVEKKNWVER NSYSCSWHEGLHNHHTTKSFSRTPG (SEQ ID NO: 281) | | |
| DNA480 | Hole: mFcIgG2a (LALAPG)-hCD122 | TIKPCPPCKCPAPNAAGGPSVFIFP PKIKDVLMISLSPIVTCVVVDVSED DPDVQISWFVNNVEVHTAQTQTHRE DYNSTLRVVSALPIQHQDWMSGKEF KCKVNNKDLGAPIERTISKPKGSVR APQVCVLPPPEEEMTKKQVTLSCAV TDFMPEDIWEWTNNGKTELNYKNTE PVLDSDGSYFMVSKLRVEKKNWVER NSYSCSWHEGLHNHHTTKSFSRTPG (SEQ ID NO: 281) | PGSGS (SEQ ID NO: 14) | AVNGTSQFTCFYNSRANISCVWSQDGALQDT SCQVHAWPDRRRWNQTCELLPVSQASWACN LILGAPDSQKLTTVDIVTLRVLCREGVRWR VMAIQDFKPFENLRLMAPISLQVVHVETHR CNISWEISQASHYFERHLEFEARTLSPGHT WEEAPLLTLKQKQEWICLETLTPDTQYEFQ VRVKPLQGEFTTWSPWSQPLAFRTKPAALG KD (SEQ ID NO: 4) |
| DNA516 | FSSc FvVersion1-Hole: hFc(N297A)-hCD122 | EVQLLESGGGLVQPGGSLRLSCAASG FTFSLFTMSWVRQAPGKGLEVVVSA ISGSGGSTYYADSVKGRFTISRDNS KNTLYLQMNSLRAEDTAVYYCAKST HLYLFDYWGQGTLVTVSSGGGGSGG GGSGGGGSEIVLTQSPGTLSLSPGE RATLSCRASQSVSMPFLAWYQQKPG QAPRLLIYGASSRATGIPDRFSGSG SGTDFTLTISRLEPEDFAVYYCQQM RGRPPTFGQGTKVEIK (SEQ ID NO: 282) | GGS | DKTHTCPPCPAPELLGGPSVFLFPPKPKDTL MISRTPEVTCVVVDVSHEDPEVKFNWYVDGV EVHNAKTKPREEQYASTYRVVSVLTVLHQDW LNGKEYKCKVSNKALPAPIEKTISKAKGQPR EPQVCTLPPSRDELTKNQVSLSCAVKGFYPS DIAVEWESNGQPENNYKTTPPVLDSDGSFFL VSKLTVDKSRWQQGMVFSCSVMHEALHNHY TQKSLSLSPG (SEQ ID NO: 9) |
| DNA520 | Hole: mFcIgG2a (LALAPG)-NoAnnotation Found | TIKPCPPCKCPAPNAAGGPSVFIFP PKIKDVLMISLSPIVTCVVVDVSED DPDVQISWFVNNVEVHTAQTQTHRE DYNSTLRVVSALPIQHQDWMSGKEF KCKVNNKDLGAPIERTISKPKGSVR APQVCVLPPPEEEMTKKQVTLSCAV TDFMPEDIWEWTNNGKTELNYKNTE | HHHHHHHH (SEQ ID NO: 308) | |

| | | |
|---|---|---|
| DNA521 | Hole: mFcIgG2a (LALAPG)-hCD122-NoAnnotation Found | PVLDSDGSYFMVSKLRVEKKNWVER NSYSCSWHEGLHNHHTTKSFSRTPG (SEQ ID NO: 281) | PGSGS (SEQ ID NO: 14) | AVNGTSQFTCFYNSRANISCVWSQDGALQDT SCQVHAWPDRRRWNQTCELLPVSQASWACN LILGAPDSQKLTTVDIVTLRVLCREGVRMR VMAIQDFKFPENLRLMAPISLQVVHVETHR CNISWEISQASHYFERHLEFEARTLSPGHT WEEAPLLTLKQKQEWICLETLTPDTQYEFQ VRVKPLQGEFTTWSPWSQPLAFRTKPAALG KD (SEQ ID NO: 4) |
| DNA522 | Hole: mFcIgG2a (LALAPG)-mCD122-NoAnnotation Found | TIKPCPPCKCPAPNAAGGPSVFIFPP PKIKDVLMISLSPIVTCVVVDVSED DPDVQISWFVNNVEVHTAQTQTHRE DYNSTLRVVSALPIQHQDWMSGKEF KCKVNNKDLGAPIERTISKPKGSVR APQVCVLPPPEEEMTKKQVTLSCAV TDFMPEDIWEWTNNGKTELNYKNTE PVLDSDGSYFMVSKLRVEKKNWVER NSYSCSWHEGLHNHHTTKSFSRTPG (SEQ ID NO: 281) | PGSGS (SEQ ID NO: 14) | AVKNCSHLECFYNSRANVSCMWSHEEALNV TTCHVHAKSNLRHWNKTCELTLVRQASWAC NLILGSFPESQSLTSVDLLDINWCWEEKGWR RVKTCDFHPFDNLRLVAPHSLQVLHIDTQR CNISWKVSQVSHYIEPYLEFEARRLLGHS WEDASVLSLKQRQQWLFLEMLIPSTSYEVQ VRVKAQRNNTGTWSPWSQPLTFRTRPADPM KE (SEQ ID NO: 326) |
| DNA528 | Hole: hFc(N297A)-hCD122 (C168S) | DKTHTCPPCPAPELLGGPSVFLFPPKPKDTL MISRTPEVTCVVVDVSHEDPEVKFNWYVDGV EVHNAKTKPREEQYASTYRVVSVLTVLHQDW LNGKEYKCKVSNKALPAPIEKTISKAKGQPR EPQVCTLPPSRDELTKNQVSLSCAVKGFYPS DIAVEWESNGQPENNYKTTPPVLDSDGSFFL VSKLTVDKSRWQQGMVFSCSVMHEALHNHY TQKSLSLSPG (SEQ ID NO: 9) | PGSGS (SEQ ID NO: 14) | AVNGTSQFTCFYNSRANISCVWSQOGALQD TSCQVHAWPDRRRWNGTCELLPVSQASWAC NLIIGAPDSQKLTTVDIVTLRVLCREGVRMR VMAIGDFKFPENLRIMAPISLQVVHVETHR CNISWEISQASHYFERHLEFEARTLSPGHT WEEAPLLTLKQKQEWISLETLTPDTQYEFQ YRVKPLQGEFTTWSPWSQPLAFRTKPAALGK D (SEQ ID NO: 327) |
| DNA530 | Knob: mFcIgG1 (DAPG)-hIL2 (R38A, F42A, Y45A, E62A, C125A) | VRSGCKPCICTVPEVSSVFIFPPKP KDVLTITLTPKVTCVVVAISKDDPE VQFSWFVDDVEVHTAQTQPSEEQFN STFRSVSELPIMHQDWLNGKEFKCR VNSAAFGAPIEKTISKTKGRPKAPQ VYTIPPPKEQMAKDKVSLTCMITDF FPEDITVEWQWNGQPAENYDNTQPI MDTDGSYFVYSDLNVQKSNWEAGNT FTCSVLHEGIHNHHTEKSLSHSPG (SEQ ID NO: 283) | GGSSPP GGGSSG GGSGP (SEQ ID NO: 23) | APTSSSTKKTQL QLEHLLDLQMILNGINNYKNPKL TAMLTAKFAMPKKATELKHLQCL EEALKPLEEVLNLAQSKNFHLRPR DLISNINIVLELKGSETTFMCEY ADETATIVEFLNRWITFAQSIISTLT (SEQ ID NO: 3) |
| DNA531 | Knob: mFcIgG1 (DAPG)-[VPLSLY]-hIL2 (R38A, | VRSGCKPCICTVPEVSSVFIFPPKP KDVLTITLTPKVTCVVVAISKDDPE VQFSWFVDDVEVHTAQTQPSEEQFN STFRSVSELPIMHQDWLNGKEFKCR VNSAAFGAPIEKTISKTKGRPKAPQ VYTIPPPKEQMAKDKVSLTCMITDF | GSPG (SEQ ID NO: 34) | VPLSLY (SEQ ID NO: 28) |

| | | -continued | |
|---|---|---|---|
| | F42A, Y45A, E62A, C125A) | FPEDITVEWQWNGQPAENYDNTQPI MQTDGSYFVYSDLNVQKSNWEAGNT FTCSVLHEGIHNHHTEKSLSHSPG (SEQ ID NO: 283) | |
| DNA532 | Hole: mFcIgG1 (DAPG) | VRSGCKPCICTVPEVSSVFIFPPKP KDVLTSTLTPKVTCVVVAISKDDPE VQFSWFVDDVEVHTAQTQPREEQFN STFRSVSELPIMHQDWINGKEFKCR VNSAAFGAPIEKTISKTKGRPKAPQ VYTIPPPKKQMAKDKVSLTCMITDF FPEDITVEWQWNGQPAENYKNTQPI MKTDGSYFVYSKLNVQKSNWEAGNT FTCSVLHEGLHNHHTEKSLSHSPG (SEQ ID NO: 284) | |
| DNA533 | Hole: mFcIgG1 (DAPG)- hCD122 | VRSGCKPCICTVPEVSSVFIFPPKP KDVLTSTLTPKVTCVVVAISKDDPE VQFSWFVDDVEVHTAQTQPREEQFN STFRSVSELPIMHQDWINGKEFKCR VNSAAFGAPIEKTISKTKGRPKAPQ VYTIPPPKKQMAKDKVSLTCMITDF FPEDITVEWQWNGQPAENYKNTQPI MKTDGSYFVYSKLNVQKSNWEAGNT FTCSVLHEGLHNHHTEKSLSHSPG PGSGS (SEQ ID NO: 14) | AVNGTSQFTCFYNSRANISCVWSQDGALQDT SCQVHAWPDRRRWNQTCELLPVSQASWACN LILGAPDSQKLTTVDIVTLRVLCREGVRWR VMAIQDFKPFENLRLMAPISLQVVHVETHR CNISWEISQASHYPERHLEFEARTLSPGHT WEEAPLLTLKQKQEWICLETLTPDTQYEFQ VRVKPLQGEFTTWSPWSQPLAFRTKPAALG KD (SEQ ID NO: 4) |
| DNA534 | Hole: mFcIgG1 (DAPG)- mCD122 | VRSGCKPCICTVPEVSSVFIFPPKP KDVLTSTLTPKVTCVVVAISKDDPE VQFSWFVDDVEVHTAQTQPREEQFN STFRSVSELPIMHQDWINGKEFKCR VNSAAFGAPIEKTISKTKGRPKAPQ VYTIPPPKKQMAKDKVSLTCMITDF FPEDITVEWQWNGQPAENYKNTQPI MKTDGSYFVYSKLNVQKSNWEAGNT FTCSVLHEGLHNHHTEKSLSHSPG | AVKNCSHLECFYNSRANVSCMWSHEEALNV TTCHVHAKSNLRHWNKTCELTLVRQASWAC NLILGSFPESQSLTSVDLLDINWCWEEKGWR RVKTCDFHPFDNLRLVAPHSLQVLHIDTQR CNISWKVSQVSHYIEPYLEFEARRLLGHS WEDASVLSLKQRQQWLFLEMLIPSTSYEVQ VRVKAQRNNTGTWSPWSQPLTFRTRPADFM KE (SEQ ID NO: 326) |
| DNA542 | Knob: hFc(N297A)- hIL2(R38A, F42A, Y45A, E62A, C125A) | DKTHTCPPCPAPELLGGPSVFLFPPKP PKDTLMISRTPEVTCVVVDVSHEDP EVKFNWYVDGVEVHNAKTKPREEQY ASTYRVVSVLTVLHQDWLNGKEYKC KVSNKALPAPIEKTISKAKGQPREP QVVTLPPCRDELTKNQVSLWCLVKG FYPSDSAVEWESNGQPENNYKTTPP VLDSDGSFFLYSKITVDKSRWQQGN VFSCSVMHEALHNHYTQKSLSLSPG (SEQ ID NO: 12) | APTSSSTKKTQL QLEHLLLDLQMILNGINNYKNPKL TAMLTAKFAMPKKATELKHLQCL EEALKPLEEVLNLAQSKNFHLRPR DLISNINIVLELKGSETTFMCEY ADETATIVEFLNRWITFAQSIISTLT (SEQ ID NO: 3) |
| DNA543 | Hole: hFc(N297A) [VPLSLY] hCD122 | DKTHTCPPCPAPELLGGPSVFLFPPKPKDTL MISRTPEVTCVVVDVSHEDPEVKFNWYVDGV EVHNAKTKPREEQYASTYRVVSVLTVLHQDW LNGKEYKCKVSNKALPAPIEKTISKAKGQPR GPPSG SSPG (SEQ ID | VPLSLY (SEQ ID NO: |

| | | | |
|---|---|---|---|
| | | | EPQVCTLPPSRDELTKNQVSLSCAVKGFYPS DIAVEWESNGQPENNYKTTPPVLDSDGSFFL VSKLTVDKSRWQQGMVFSCSVMHEALHNHY TQKSLSLSPG (SEQ ID NO: 9) | NO: 28) |
| DNA544 | Knob: hFc(N297A)- [VPLSLY]- hIL2(R38A, F42A, Y45A, E62A, L30F, R81D, L85V, I86V, I92F, C125A) | DKTHTCPPCPAPELLGGPSVFLPPK PKDTLMISRTPEVTCVVVDSHEDP EVKFNWYVDGVEVHNAKTKPREEQY ASTYRVVSVLTVLHQDWLNGKEYKC KVSNKALPAPIEKTISKAKGQPREP QVVTLPPCRDELTKNQVSLWCLVKG FYPSDSAVEWESNGQPENNYKTTPP VIDSDGSFFLYSKITVDKSRWQQGN VFSCSVMHEALHNHYTQKSLSLSPG (SEQ ID NO: 12) | VPLSLY GSPG (SEQ ID NO: 34) |
| DNA545 | Knob: hFc(N297A)- hIL2(R38A, F42A, Y45A, E62A, L80F, R81D, L85V, I86V, I92F C125A) | DKTHTCPPCPAPELLGGPSVFLPPK PKDTLMISRTPEVTCVVVDSHEDP EVKFNWYVDGVEVHNAKTKPREEQY ASTYRVVSVLTVLHQDWLNGKEYKC KVSNKALPAPIEKTISKAKGQPREP QVVTLPPCRDELTKNQVSLWCLVKG FYPSDSAVEWESNGQPENNYKTTPP VIDSDGSFFLYSKITVDKSRWQQGN VFSCSVMHEALHNHYTQKSLSLSPG (SEQ ID NO: 12) | GISGLL SGRSSGP SGRSSGP GGGSGP (SEQ ID NO: 311) APTSSSTKKTQL QLEHLLDLQMILNGINNYKNPKL TAMLTAKFAMPKKATELKHLQCL EEALKPLEEVLNLAQSKNFHLRPR DLISNINVIVLELKGSETTFMCEY ADETATIVEFLNRWITFAQSIISTLT (SEQ ID NO: 3) |
| DNA546 | Knob: hFc(N297A)- hIL2(R38A, F42A, Y45A, E62A, L80F, R81D, L85V, I86V, I92F C125A) | DKTHTCPPCPAPELLGGPSVFLPPK PKDTLMISRTPEVTCVVVDSHEDP EVKFNWYVDGVEVHNAKTKPREEQY ASTYRVVSVLTVLHQDWLNGKEYKC KVSNKALPAPIEKTISKAKGQPREP QVVTLPPCRDELTKNQVSLWCLVKG FYPSDSAVEWESNGQPENNYKTTPP VIDSDGSFFLYSKITVDKSRWQQGN VFSCSVMHEALHNHYTQKSLSLSPG (SEQ ID NO: 12) | GGSSPP GGGSSG GGSGP (SEQ ID NO: 23) APTSSSTKKTQLQIEHLLDLQMIINGINNY KNPKLTAMLTAKFAMPKKATELKHLQCLEE ALKPLEEVLNLAQSKNFHFDPRDVVSNINV FVLELKGSETTFMCEYADETATIVEFLNRW ITFAQSIISTLT (SEQ ID NO: 328) |
| DNA547 | Hole: hFcIgG1 (N297A + EPKSS)- hFc(N297A)- hCD122 | EPKSSDKTHTCPPCPAPELLGGPSV FLFPPKPDTLMISRTPEVTCVVVD VSHEDPEVKFNWYVQGVEVHNAKTK PREEQYASTYRVVSVLTVLHQDWLN GKEYKCKVSNKALPAPIEKTISKAK GQPREPQVCTLPPSRDELTKNQVSL SCAVKGFYPSDIAVEWESNGQPENN YKTTPPVLDSDGSFFLVSKLTVDKS RWQQGNVFSCSVMHEALHNHYTQKS LSLSPG (SEQ ID NO: 285) | DKTHTCPPCPAPELLGGPSVFLPPKPKDTL MISRTPEVTCVVVDSHEDPEVKFNWYVDGV EVHNAKTKPREEQYASTYRVVSVLTVLHQDW LNGKEYKCKVSNKALPAPIEKTISKAKGQPR EPQVCTLPPSRDELTKNQVSLSCAVKGFYPS DIAVEWESNGQPENNYKTTPPVLDSDGSFFL VSKLTVDKSRWQQGMVFSCSVMHEALHNHY TQKSLSLSPG (SEQ ID NO: 9) | PGSGS (SEQ ID NO: 14) |
| DNA548 | Hole: hFcIgG1 | AKTDKTHTCPPCPAPELLGGPSVFL FPPKPKDTLMISRTPEVTCVVVDVS | DKTHTCPPCPAPELLGGPSVFLPPKPKDTL MISRTPEVTCVVVDSHEDPEVKFNWYVDGV | PGSGS (SEQ |

| | Description | Sequence 1 | Sequence 2 |
|---|---|---|---|
| | (N297A) + AKT)-Hole: hFc(N297A)-hCD122 | HEDPEVKFNWYVDGVEVHNAKTKPR EEQYASTYRWSVLTVLHQDWLNGKE YKCKVSNKALPAPIEKTISKAKGQP REPQVCTLPPSRDELTKNQVSLSCA VKGFYPSDIAVEWESNGQPENNYKT TPPVLDSDGSFFLVSKLTVDKSRWQ QGNVFSCSVMHEALHNHYTQKSLSL SPG (SEQ ID NO: 286) | EVHNAKTKPREEQYASTYRVVSVLTVLHQDW LNGKEYKCKVSNKALPAPIEKTISKAKGQPR EPQVCTLPPSRDELTKNQVSLSCAVKGFYPS DIAVEWESNGQPENNYKTTPPVLDSDGSFFL VSKLTVDKSRWQQGMVFSCSVMHEALHNHY TQKSLSLSPG (SEQ ID NO: 9) | ID NO: 14) |
| DNA549 | Hole: hFcIgG1 (N297A + AKTEP KSS)- Hole: hFc(N297A + EPKSS) - hFc(N297A)-hCD122 | AKTEPKSSDKTHTCPPCPAPELLGGPSVFL FPPKPKDTLMISRTPEVTCVVVDVSHEDPE VKFNWYVDGVEVHNAKTKPREEQYASTYRV VSVLTVLHQDWLNGKEYKCKVSNKALPAPI EKTISKAKGQPREPQVCTLPPSRDELTKNQ VSLSCAVKGFYPSDIAVEWESNGQPENNYK TTPPVLDSDGSFFLVSKLTVDKSRWQQGNV FSCSVMHEALHNHYTQKSLSLSPG (SEQ ID NO: 287) | EPKSSDKTHTCPPCPAPELLGGPSV FLFPPKPKDTLMISRTPEVTCVVVD VSHEDPEVKFNWYVQGVEVHNAKTK PREEQYASTYRVVSVLTVLHQDWLN GKEYKCKVSNKALPAPIEKTISKAK GQPREPQVCTLPPSRDELTKNQVSL SCAVKGFYPSDIAVEWESNGQPENN YKTTPPVLDSDGSFFLVSKLTVDKS RWQQGNVFSCSVMHEALHNHYTQKS LSLSPG (SEQ ID NO: 285) | DKTHTCPPCPAPELLGGPSVFLPPKPKDTL MISRTPEVTCVVVDVSHEDPEVKFNWYVDGV EVHNAKTKPREEQYASTYRVVSVLTVLHQDW LNGKEYKCKVSNKALPAPIEKTISKAKGQPR EPQVCTLPPSRDELTKNQVSLSCAVKGFYPS DIAVEWESNGQPENNYKTTPPVLDSDGSFFL VSKLTVDKSRWQQGMVFSCSVMHEALHNHY TQKSLSLSPG (SEQ ID NO: 9) |
| DNA550 | Knob: hFcIgG1 (N297A + AKT)-[VPLSLY]-hIL2 (R38A, F42A, Y45A, E62A, C125A) | FPKSSDKTHTCPPCPAPELLGGPSVFLPPP KPKDTLMISRTPEVTCVVVDVSHEDPEVKF NWYVDGVEVHNAKTKPREEQYASTYRVVSV LTVLHQQWLNGKEYKCKVSNKALPAPIEKT ISKAKGQPREPQVVTLPPCRDELTKNQVSL WCLVKGFYPSDIAVEWESNGQPENNYKTTP PVLDSDGSFFLYSKLTVDKSRYVQQGNVFS CSVMHEALHNHYTQKSLSLSPG (SEQ ID NO: 288) | GSPG (SEQ ID NO: 34) | VPLSLY (SEQ ID NO: 28) |
| DNA551 | Knob: hFcIgG1 (N297A + AKT)-[VPLSLY]-hIL2 (R38A, F42A, Y45A, E62A, C125A) | AKTDKTHTCPPCPAPELLGGPSVELFPPKP KDTLMISRTPEVTCVVVDVSHEDPEVKFNW YVDGVEVHNAKTKPREEQYASTYRVVSVLT VLHQDWLNGKEYKCKVSNKALPAPIEKTIS KAKGQPREPQVVTLPPCRDELTKNQVSLMC LVKGFYPSDIAVEWESNGQPENNYKTTPPV LDSDGSFLYSKLTVDKSRWQQCNVFSCSV MHEALHNHYTQKSLSLSPG (SEQ ID NO: 289) | GSPG (SEQ ID NO: 34) | VPLSLY (SEQ ID NO: 28) |
| DNA552 | Knob: hFcIgG1 (N297A + AKTEPKSS) Knob: [VPLSLY]- | AKTEPKSSDKTHTCPPCPAPELLGGPSVFLF PPKPKDTLMISRTPEVTCVVVDVSHEDPEV KFNVVYDGVEVHNAKTKPREEQYASTYRV VSVLTVLHQDWLNGKEYKCKVSNKALPAPI EKTISKAKGQPREPQWTLPPCRDELTKNQV SLWCLVKGFYPSDIAVEWESNGQPENNYKT | GSPG (SEQ ID NO: 34) | VPLSLY (SEQ ID NO: 28) |

| | | | |
|---|---|---|---|
| | hIL2 (R38A, F42A, Y45A, E62A, C125A) | TPPVLDSDGSFFLYSKLTVDKSRVVQQGNV FSCSVMHEALHNHYTQKSLSLSPG (SEQ ID NO: 290) | |
| DNA553 | Hole: hFc(N297A)- [DSGFMLT]- hCD122 | DKTHTCPPCPAPELLGGPSVFLPPKPKDTL MISRTPEVTCVVVDVSHEDPEVKFNWYVDGV EVHNAKTKPREEQYASTYRVVSVLTVLHQDW LNGKEYKCKVSNKALPAPIEKTISKAKGQPR EPQVCTLPPSRDELTKNQVSLSCAVKGFYPS DIAVEWESNGQPENNYKTTPPVLDSDGSFFL VSKLTVDKSRWQQGMVFSCSVMHEALHNHY TQKSLSLSPG (SEQ ID NO: 9) | GPPSG SSPG (SEQ ID NO: 36) | DSGGFMLT (SEQ ID NO: 25) |
| DNA554 | Knob: hFc(N297A)- [VPLSLY]- hIL2 (E15R, L18C, D20R, R38A, F42A, Y45A, E62A) | DKTHTCPPCPAPELLGGPSVFLPPK PKDTLMISRTPEVTCVVVDVSHEDP EVKFNWYVDGVEVHNAKTKPREEQY ASTYRVVSVLTVLHQDWLNGKEYKC KVSNKALPAPIEKTISKAKGQPREP QVVTLPPCRDELTKNQVSLWCLVKG FYPSDSAVEWESNGQPENNYKTTPP VIDSDGSFFLYSKITVDKSRWQQGN VFSCSVMHEALHNHYTQKSLSLSPG (SEQ ID NO: 12) | GSPG (SEQ ID NO: 34) | VPLSLY (SEQ ID NO: 28) |
| DNA563 | Knob: hFc(N297A)- [VPLSLY]- hIL2 (E15R, L18C, D20R, R38A, F42A, Y45A, E62A, N88L) | DKTHTCPPCPAPELLGGPSVFLPPK PKDTLMISRTPEVTCVVVDVSHEDP EVKFNWYVDGVEVHNAKTKPREEQY ASTYRVVSVLTVLHQDWLNGKEYKC KVSNKALPAPIEKTISKAKGQPREP QVVTLPPCRDELTKNQVSLWCLVKG FYPSDSAVEWESNGQPENNYKTTPP VIDSDGSFFLYSKITVDKSRWQQGN VFSCSVMHEALHNHYTQKSLSLSPG (SEQ ID NO: 12) | GSPG (SEQ ID NO: 34) | VPLSLY (SEQ ID NO: 28) |
| DNA565 | Knob: hFc(N297A)- [VPLSLY]- hIL2 (E15R, L18C, D20R, R38A, F42A, Y45A, E62A, N88L) | DKTHTCPPCPAPELLGGPSVFLPPK PKDTLMISRTPEVTCVVVDVSHEDP EVKFNWYVDGVEVHNAKTKPREEQY ASTYRVVSVLTVLHQDWLNGKEYKC KVSNKALPAPIEKTISKAKGQPREP QVVTLPPCRDELTKNQVSLWCLVKG FYPSDSAVEWESNGQPENNYKTTPP VIDSDGSFFLYSKITVDKSRWQQGN VFSCSVMHEALHNHYTQKSLSLSPG (SEQ ID NO: 12) | GSPG (SEQ ID NO: 34) | VPLSLY (SEQ ID NO: 28) |

| | | | |
|---|---|---|---|
| DNA566 | Knob: hFc(N297A)-[VPLSLY]-hIL2 (E15R, L18C, F42A, R38A, Y45A, E62A, N88L) | DKTHTCPPCPAPELLGGPSVFLFPPK PKDTLMISRTPEVTCVVVDVSHEDP EVKFNWYVDGVEVHNAKTKPREEQY ASTYRVVSVLTVLHQDWLNGKEYKC KVSNKALPAPIEKTISKAKGQPREP QVYTLPPCRDELTKNQVSLWCLVKG FYPSDSAVEWESNGQPENNYKTTPP VIDSDGSFFLYSKLTVDKSRWQQGN VFSCSVMHEALHNHYTQKSLSLSPG (SEQ ID NO: 12) | GSPG (SEQ ID NO: 34) | VPLSLY (SEQ ID NO: 28) |
| DNA567 | Knob: hFc(N297A)-[VPLSLY]-hIL2 (L18C, D20R, R38A, F42A, Y45A, E62A, N88L) | DKTHTCPPCPAPELLGGPSVFLFPPK PKDTLMISRTPEVTCVVVDVSHEDP EVKFNWYVDGVEVHNAKTKPREEQY ASTYRVVSVLTVLHQDWLNGKEYKC KVSNKALPAPIEKTISKAKGQPREP QVYTLPPCRDELTKNQVSLWCLVKG FYPSDSAVEWESNGQPENNYKTTPP VIDSDGSFFLYSKLTVDKSRWQQGN VFSCSVMHEALHNHYTQKSLSLSPG (SEQ ID NO: 12) | GSPG (SEQ ID NO: 34) | VPLSLY (SEQ ID NO: 28) |
| DNA568 | Knob: hFc(N297A)-[VPLSLY]-hIL2 (E15F, L18C, D20R, R38A, F42A, Y45A, E62A, N88L) | DKTHTCPPCPAPELLGGPSVFLFPPK PKDTLMISRTPEVTCVVVDVSHEDP EVKFNWYVDGVEVHNAKTKPREEQY ASTYRVVSVLTVLHQDWLNGKEYKC KVSNKALPAPIEKTISKAKGQPREP QVYTLPPCRDELTKNQVSLWCLVKG FYPSDSAVEWESNGQPENNYKTTPP VIDSDGSFFLYSKLTVDKSRWQQGN VFSCSVMHEALHNHYTQKSLSLSPG (SEQ ID NO: 12) | GSPG (SEQ ID NO: 34) | VPLSLY (SEQ ID NO: 28) |
| DNA575 | Hole: hFc(N297A, I253A)-hCD122 | DKTHTCPPCPAPELLGGPSVFLFPPKPKDTL MASRTPEVTCVVVDVSHEDPEVKFNWYVDG VEVHNAKTKPREEQYASTYRVVSVLTVLHQ DWLNGKEYKCKVSNKALPAPIEKTISKAKG QPREPQVCTIPPSRDELTKNQVSLSCAVKG FYPSDIAVEWESNGQPENNYKTTPPVLDSD GSFFLVSKLTVDKSRWQQGNVFSCSVMHEA LHNHYTQKSLSLSPG (SEQ ID NO: 10) | PGSGS (SEQ ID NO: 14) | AVNGTSQFTCF YNSRANISCVW SQDGALQDTSC QVHAWPDRRR WNQTCELLPVS QASWACNLILG APDSQKLTVDI VTLRVLCREGVR WRVMAIQDFK PFENLRLMAPIS LQVHVETHRC NISWEISQASHY FERHLEFEARTL SPGHTWEEAPL LTLKQKQEWICL ETLTPDTQYEFQ VRVKPLQGEFTT |

-continued

| | | | |
|---|---|---|---|---|
| DNA576 | Hole: hFc(N297A, M252Y, S254T, T256E)- hCD122 | DKTHTCPPCPAPELLGGPSVFLFPP KPKDTLYITREPEVTCVVVDVSHED PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFLVSKLTVDKSRWQQG NVFSCSVMHEALHNHYTQKSLSLSP G (SEQ ID NO: 292) | PGSGS (SEQ ID NO: 14) | WSPWSQPLAFR TKPAALGKD (SEQ ID NO: 4) AVNGTSQFTCFYNSRANISCVW SQDGALQDTSCQVHAWPDRRR WNQTCELLPVSQASWACNLILG APDSQKLTTVDIVTLRVLCREGVR WRVMAIQDFKPFENLRLMAPIS LQVHVETHRCNISWEISQASHY FERHLEFEARTLSPGHTWEEAPL LTLKQKQEWICLETLTPDTQYEFQ VRVKPLQGEFTTWSPWSQPLAFR TKPAALGKD (SEQ ID NO: 4) |
| DNA577 | Knob: hFc(N297, I253A)- hIL2(R38A, F42A, Y45A, E62A, C125A) | DKTHTCPPCPAPELLGGPSVFLFPP KPKDTLMASRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 13) | GGSSPPG GGSSG GGSGP (SEQ ID NO: 23) | APTSSSTKKTQL QLEHLLLDLQMILNGINNYKNPKL TAMLTAKFAMPKATELKHLQCL EEALKPLEEVLNLAQSKNFHLRPR DLISNINVIVLELKGSETTFMCEY ADETATIVEFLNRWITFAQSIISTLT (SEQ ID NO: 3) |
| DNA578 | Knob: hFc(N297A, M252Y, S254T, T256E)- hIL2(R38A, F42A, Y45A, E62A, C125A) | DKTHTCPPCPAPELLGGPSVFLFPP KPKDTLYITREPEVTCWDVSHEDP EVKFNWYVDGVEVHNAKTKPREEQY ASTYRWSVLTVLHQDWLNGKEYKCK VSNKALPAPIEKTISKAKGQPREPQ VYTLPPCRDELTKNQVSLWCLVKGF YPSDIAVEWESNGQPENNYKTTPPV LDSDGSFFLYSKLTVDKSRWQQGNV FSCSVMHEALHNHYTQKSLSLSPG (SEQ ID NO: 294) | GGSSPPG GGSSG GGSGP (SEQ ID NO: 23) | APTSSSTKKTQL QLEHLLLDLQMILNGINNYKNPKL TAMLTAKFAMPKATELKHLQCL EEALKPLEEVLNLAQSKNFHLRPR DLISNINVIVLELKGSETTFMCEY ADETATIVEFLNRWITFAQSIISTLT (SEQ ID NO: 3) |
| DNA579 | Knob: hFc(N297, I253A)- [VPLSLY]- hIL2 (R38A, F42A, Y45A, E62A, C125A) | DKTHTCPPCPAPELLGGPSVFLFPP KPKDTLMASRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRWQQG NVFSCSVMHEALHNHYTQKSLSLSP G (SEQ ID NO: 13) | GSPG (SEQ ID NO: 34) | VPLSLY (SEQ ID NO: 28) |
| DNA580 | Knob: hFc(N297A, M252Y, S254T, T256E)- | DKTHTCPPCPAPELLGGPSVFLFPP KPKDTLYITREPEVTCWDVSHEDP EVKFNWYVDGVEVHNAKTKPREEQY ASTYRWSVLTVLHQDWLNGKEYKCK | GSPG (SEQ ID NO: 34) | VPLSLY (SEQ ID NO: 28) |

-continued

| | | | | |
|---|---|---|---|---|
| | [VPLSLY]- hIL2 (R38A, F42A, Y45A, E62A, C125A) | VSNKALPAPIEKTISKAKGQPREPQ VYTLPPCRDELTKNQVSLWCLVKGF YPSDIAVEWESNGQPENNYKTTPPV LDSDGSFFLYSKLTVDKSRWQQGNV FSCSVMHEALHNHYTQKSLSLSPG (SEQ ID NO: 294) | | |
| DNA581 | Knob: hFc(N297A)- [VPLSLY]- hIL2(L18C, R38A, F42A, Y45A, E62A) | DKTHTCPPCPAPELLGGPSVFLFPPK PKDTLMISRTPEVTCVVVDVSHEDP EVKFNWYVDGVEVHNAKTKPREEQY ASTYRVVSVLTVLHQDWLNGKEYKC KVSNKALPAPIEKTISKAKGQPREP QVYTLPPCRDELTKNQVSLWCLVKG FYPSDSAVEWESNGQPENNYKTTPP VIDSDGSFFLYSKITVDKSRWQQGN VFSCSVMHEALHNHYTQKSLSLSPG (SEQ ID NO: 12) | GSPG (SEQ ID NO: 34) | VPLSLY (SEQ ID NO: 28) |
| DNA582 | Knob: hFc(N297A)- [VPLSLY]- hIL2(H16Y, R38A, F42A, Y45A, E62A, C125A) | DKTHTCPPCPAPELLGGPSVFLFPPK PKDTLMISRTPEVTCVVVDVSHEDP EVKFNWYVDGVEVHNAKTKPREEQY ASTYRVVSVLTVLHQDWLNGKEYKC KVSNKALPAPIEKTISKAKGQPREP QVYTLPPCRDELTKNQVSLWCLVKG FYPSDSAVEWESNGQPENNYKTTPP VIDSDGSFFLYSKITVDKSRWQQGN VFSCSVMHEALHNHYTQKSLSLSPG (SEQ ID NO: 12) | GSPG (SEQ ID NO: 34) | VPLSLY (SEQ ID NO: 28) |
| DNA583 | Knob: hFc(N297A)- [VPISLY]- hIL2(H16E, R38A, F42A, Y45A, E62A, C125A) | DKTHTCPPCPAPELLGGPSVFLFPPK PKDTLMISRTPEVTCVVVDVSHEDP EVKFNWYVDGVEVHNAKTKPREEQY ASTYRVVSVLTVLHQDWLNGKEYKC KVSNKALPAPIEKTISKAKGQPREP QVYTLPPCRDELTKNQVSLWCLVKG FYPSDSAVEWESNGQPENNYKTTPP VIDSDGSFFLYSKITVDKSRWQQGN VFSCSVMHEALHNHYTQKSLSLSPG (SEQ ID NO: 12) | GSPG (SEQ ID NO: 34) | VPLSLY (SEQ ID NO: 28) |
| DNA584 | Knob: hFc(N297A)- [VPLSLY]- hIL2 (D20L, R38A, F42A, Y45A, E62A, C125A) | DKTHTCPPCPAPELLGGPSVFLFPPK PKDTLMISRTPEVTCVVVDVSHEDP EVKFNWYVDGVEVHNAKTKPREEQY ASTYRVVSVLTVLHQDWLNGKEYKC KVSNKALPAPIEKTISKAKGQPREP QVYTLPPCRDELTKNQVSLWCLVKG FYPSDSAVEWESNGQPENNYKTTPP VIDSDGSFFLYSKITVDKSRWQQGN VFSCSVMHEALHNHYTQKSLSLSPG (SEQ ID NO: 12) | GSPG (SEQ ID NO: 34) | VPLSLY (SEQ ID NO: 28) |

-continued

| | | | |
|---|---|---|---|
| DNA585 | Knob: hFc(N297A)-[VPLSLY]-hIL2(H16Y, L18C, R38A, F42A, Y45A, E62A) | DKTHTCPPCPAPELLGGPSVFLFPPK PKDTLMISRTPEVTCVVVDVSHEDP EVKFNWYVDGVEVHNAKTKPREEQY ASTYRVVSVLTVLHQDWLNGKEYKC KVSNKALPAPIEKTISKAKGQPREP QVYTLPPCRDELTKNQVSLWCLVKG FYPSDSAVEWESNGQPENNYKTTPP VIDSDGSFFLYSKITVDKSRWQQGN VFSCSVMHEALHNHYTQKSLSLSPG (SEQ ID NO: 12) | GSPG (SEQ ID NO: 34) VPLSLY (SEQ ID NO: 28) |
| DNA586 | Knob: hFc(N297A)-[VPLSLY]-hIL2(H16E, L18C, R38A, F42A, Y45A, E62A) | DKTHTCPPCPAPELLGGPSVFLFPPK PKDTLMISRTPEVTCVVVDVSHEDP EVKFNWYVDGVEVHNAKTKPREEQY ASTYRVVSVLTVLHQDWLNGKEYKC KVSNKALPAPIEKTISKAKGQPREP QVYTLPPCRDELTKNQVSLWCLVKG FYPSDSAVEWESNGQPENNYKTTPP VIDSDGSFFLYSKITVDKSRWQQGN VFSCSVMHEALHNHYTQKSLSLSPG (SEQ ID NO: 12) | GSPG (SEQ ID NO: 34) VPLSLY (SEQ ID NO: 28) |
| DNA587 | Knob: hFc(N297A)-[VPLSLY]-hIL2(L18C, D20L, R38A, F42A, Y45A, E62A) | DKTHTCPPCPAPELLGGPSVFLFPPK PKDTLMISRTPEVTCVVVDVSHEDP EVKFNWYVDGVEVHNAKTKPREEQY ASTYRVVSVLTVLHQDWLNGKEYKC KVSNKALPAPIEKTISKAKGQPREP QVYTLPPCRDELTKNQVSLWCLVKG FYPSDSAVEWESNGQPENNYKTTPP VIDSDGSFFLYSKITVDKSRWQQGN VFSCSVMHEALHNHYTQKSLSLSPG (SEQ ID NO: 12) | GSPG (SEQ ID NO: 34) VPLSLY (SEQ ID NO: 28) |
| DNA588 | Knob: hFc(N297A)-[VPLSLY]-hIL2(H16Y, L18C, D20L, R38A, F42A, Y4SA, E62A) | DKTHTCPPCPAPELLGGPSVFLFPPK PKDTLMISRTPEVTCVVVDVSHEDP EVKFNWYVDGVEVHNAKTKPREEQY ASTYRVVSVLTVLHQDWLNGKEYKC KVSNKALPAPIEKTISKAKGQPREP QVYTLPPCRDELTKNQVSLWCLVKG FYPSDSAVEWESNGQPENNYKTTPP VIDSDGSFFLYSKITVDKSRWQQGN VFSCSVMHEALHNHYTQKSLSLSPG (SEQ ID NO: 12) | GSPG (SEQ ID NO: 34) VPLSLY (SEQ ID NO: 28) |
| DNA589 | Knob: hFc(N297A)-[VPISLY]-hIL2(H16E, L18C, D20L, R38A, F42A, Y4SA, | DKTHTCPPCPAPELLGGPSVFLFPPK PKDTLMISRTPEVTCVVVDVSHEDP EVKFNWYVDGVEVHNAKTKPREEQY ASTYRVVSVLTVLHQDWLNGKEYKC KVSNKALPAPIEKTISKAKGQPREP QVYTLPPCRDELTKNQVSLWCLVKG | GSPG (SEQ ID NO: 34) VPLSLY (SEQ ID NO: 28) |

| | | | |
|---|---|---|---|
| DNA603 | E62A) | FYPSDSAVEWESNGQPENNYKTPP VIDSDGSFLYSKITVDKSRWQQGN VFSCSVMHEALHNHYTQKSLSLSPG (SEQ ID NO: 12) | |
| | Hole: hFcIgG4-hCD122 | ESKYGPPCPPCPAPEFLGGP SVFLFPPKPKDTLMISRTPE VTCVVVDVSQEDPEVQFNWY VDGVEVHNAKTKPREEQFNS TYRVVSVLTVLHQDWLNGKE YKCKVSNKGLPSSIEKTISK AKGQPREPQVCTLPPSQEEM TKNQVSLSCAVKGFYPSDIA VEWESNGQPENNYKTTPPVL DSDGSFFLYSRLTVDKSRWQ EGNVFSCSVMHEALHNHYTQ KSLSLSLG (SEQ ID NO: 295) | PGSGS (SEQ ID NO: 14) | AVNGTSQFTCFYNSRANISCVW SQDGALQDTSCQVHAWPDRRR WNQTCELLPVSQASWACNLILG APDSQKLTTVDIVTLRVLCREGVR WRVMAIQDFKPFENLRLMAPIS LQVHVETHRCNISWEISQASHY FERHLEFEARTLSPGHTWEEAPL LTLKQKQEWICLETLTPDTQYEFQ VRVKPLQGEFTTWSPWSQPLAFR TKPAALGKD (SEQ ID NO: 4) |
| DNA604 | Knob: hFc(N297A)-hIL2 (R38A, F42A, Y45A, E62A, C125A) | ESKYGPPCPPCPAPEFLGGP SVFLFPPKPKDTLMISRTPE VTCVVVDVSQEDPEVQFNWY VDGVEHNAKTKPREEQFNS TYRVVSVLTVLHQDWLNGKE YKCKVSNKGLPSSIEKTISK AKGQPREPQVYTLPPSQEEM TKNQVSLSWCLVKGFYPSDI AVEWESNGQPENNYKTTPPV LDSDGSFFLYSRLTVDKSRW QEGNVFSCSVMHEALHNHYT QKSLSLSLG (SEQ ID NO: 296) | GSSPPGG GSSGG GSGP (SEQ ID NO: 23) | APTSSSTKKTQL QLEHLLDLQMILNGINNYKNPKL TAMLTAKFAMPKKATELKHLQCL EEALKPLEEVLNLAQSKNFHLRPR DLISNINVIVLELKGSETTFMCEY ADETATIVEFLNRWITFAQSIISTLT (SEQ ID NO: 3) |
| DNA605 | Knob: hFc(N297A)-[VPLSLY]-hIL2 (R38A, F42A, Y45A, E62A, C125A) | ESKYGPPCPPCPAPEFLGGP SVFLFPPKPKDTLMISRTPE VTCVVVDVSQEDPEVQFNWY VDGVEHNAKTKPREEQFNS TYRVVSVLTVLHQDWLNGKE YKCKVSNKGLPSSIEKTISK AKGQPREPQVYTLPPSQEEM TKNQVSLSWCLVKGFYPSDI AVEWESNGQPENNYKTTPPV LDSDGSFFLYSRLTVDKSRW QEGNVFSCSVMHEALHNHYT QKSLSLSLG (SEQ ID NO: 296) | GSPG (SEQ ID NO: 34) | VPLSLY (SEQ ID NO: 28) |
| DNA606 | Knob: hFc(N297A)-[RAAAVKSP]-hCD122 | DKTHTCPPCPAPELLGGPSVFLFPPKPKDTL MISRTPEVTCVVVDVSHEDPEVKPNWYVDGV EVHNAKTKPREEQYASTYRVVSVLTVLHQDW LNGKEYKCKVSNKALPAPIEKTISKAKGQPR EPQVCTLPPSRDELTKNQVSLSCAVKGFYPS DIAVEWESNGQPENNYKTTPPVLDSDGSFFL | GPPSGSSP (SEQ ID NO: 37) | RAAAVKSP (SEQ ID NO: 27) |

| | | | |
|---|---|---|---|
| DNA608 | Hole:<br>hFc(N297A,<br>I253A)-<br>[MPYDLYHP]-<br>hCD122 | VSKLTVDKSRWQQGMVFSCSVMHEALHNHY<br>TQKSLSLSPG<br>(SEQ ID NO: 9)<br>DKTHTCPPCPAPELLGGPSVFLFPP<br>KPKDTLMASRTPEVTCVVVDVSHEQ<br>PEVKFNWYVDGVEVHNAKTKPREEQ<br>YASTYRVVSVLTVLHQDWLNGKEYK<br>CKVSNKALPAPIEKTISKAKGQPRE<br>PQVCTLPPSRDELTKNQVSLSCAVK<br>GFYPSDIAVEWESNGQPENNYKTTP<br>PVLDSDGSFFIVSKLTVDKSRWQQG<br>NVFSCSVMHEALHNHYTQKSLSLSP<br>G (SEQ ID NO: 10) | GPPSGSSP<br>(SEQ ID<br>NO: 37) | MPYDLYHP<br>(SEQ ID<br>NO: 24) |
| DNA609 | Hole:<br>hFc(N297A,<br>I253A)-<br>[VPLSLY]-<br>hCD122 | DKTHTCPPCPAPELLGGPSVFLFPP<br>KPKDTLMASRTPEVTCVVVDVSHEQ<br>PEVKFNWYVDGVEVHNAKTKPREEQ<br>YASTYRVVSVLTVLHQDWLNGKEYK<br>CKVSNKALPAPIEKTISKAKGQPRE<br>PQVCTLPPSRDELTKNQVSLSCAVK<br>GFYPSDIAVEWESNGQPENNYKTTP<br>PVLDSDGSFFIVSKLTVDKSRWQQG<br>NVFSCSVMHEALHNHYTQKSLSLSP<br>G (SEQ ID NO: 10) | GPPSG<br>SSPG<br>(SEQ ID<br>NO: 36) | VPLSLY<br>(SEQ ID<br>NO: 28) |
| DNA612 | Hole:<br>hFc(N297A)-<br>[MPYDLYHP]-<br>hCD122<br>(C122S,<br>C168S) | DKTHTCPPCPAPELLGGPSVFLFPPKPKDTL<br>MISRTPEVTCVVVDVSHEDPEVKFNWYVDGV<br>EVHNAKTKPREEQYASTYRVVSVLTVLHQDW<br>LNGKEYKCKVSNKALPAPIEKTISKAKGQPR<br>EPQVCTLPPSRDELTKNQVSLSCAVKGFYPS<br>DIAVEWESNGQPENNYKTTPPVLDSDGSFFL<br>VSKLTVDKSRWQQGMVFSCSVMHEALHNHY<br>TQKSLSLSPG<br>(SEQ ID NO: 9) | GPPSGSSP<br>(SEQ ID<br>NO: 37) | MPYDLYHP<br>(SEQ ID<br>NO: 24) |
| DNA614 | Hole:<br>hFc(N297A)-<br>[DSGGFMLT]-<br>hCD122<br>(C122S,<br>C168S) | DKTHTCPPCPAPELLGGPSVFLFPPKPKDTL<br>MISRTPEVTCVVVDVSHEDPEVKFNWYVDGV<br>EVHNAKTKPREEQYASTYRVVSVLTVLHQDW<br>LNGKEYKCKVSNKALPAPIEKTISKAKGQPR<br>EPQVCTLPPSRDELTKNQVSLSCAVKGFYPS<br>DIAVEWESNGQPENNYKTTPPVLDSDGSFFL<br>VSKLTVDKSRWQQGMVFSCSVMHEALHNHY<br>TQKSLSLSPG<br>(SEQ ID NO: 9) | GPPSG<br>SSPG<br>(SEQ ID<br>NO: 36) | DSGGFMLT<br>(SEQ ID<br>NO: 25) |
| DNA621 | Hole:<br>hFcIgG4-<br>[VPLSLY]-<br>hCD122 | ESKYGPPCPPCPAPELLGGPSVFLF<br>PPKPKDTLMISRTPEVTCVVVDVSH<br>EDPEVKFNWYDGVEVHNAKTKPRE<br>EQYASTYRVVSVLTVLHQDWLNGK<br>EYKCKVSNKGLPSSIEKTISKAKGQ<br>PREPQVCTLPPSQEEMTKNQVSLSC<br>AVKGFYPSDIAVEWESMGQPENNYK | PSGSSPG<br>(SEQ ID<br>NO: 313) | VPLSLY<br>(SEQ ID<br>NO: 28) |

-continued

| | | | |
|---|---|---|---|
| DNA623 | Knob: hFc(N297A, I253A)-[MPYDLYHP]-hIL2(R38A, F42A, Y45A, E62A, C125A) | TTPPVLDSDGSFFLYSRLTVDKSRW QEGNVFSCSVMHEALHNHYTQKSLS LSLGGP (SEQ NO: 297) | MPYDLYHP (SEQ ID NO: 24) |
| | | DKTHTCPPCPAPELLGGPSVFLFPP KPKDTLMASRTPEVTCVVVDVSHED PEVKFNWYVDGVEVHNAKTKPREEQ YASTYRVVSVLTVLHQDWLNGKEYK CKVSNKALPAPIEKTISKAKGQPRE PQVYTLPPCRDELTKNQVSLWCLVK GFYPSDIAVEWESNGQPENNYKTTP PVLDSDGSFFLYSKLTVDKSRMQQG NVFSCSVMHEALHNHYTQKSLSLS PG (SEQ ID NO: 13) | GGSSPP (SEQ ID NO: 32) |
| DNA625 | Hole: hFc(N297, I253A) | DKTHTCPPCPAPELLGGPSVFLFPP KPKDTLMASRTPEVTCVVVDVSHEQ PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFIVSKLTVDKSRMQQG NVFSCSVMHEALHNHYTQKSLSLSP G (SEQ ID NO: 10) | |
| DNA626 | Hole: hFcIGg4 | ESKYGPPCPPCPAPEFLGGPSVFLFPPKPK DTLMISRTPEVTCVVVDVSQEDPEVQFNWY VDGVEVHNAKTKPREEQFNSTYRVVSVLTV LHQDWLNGKEYKCKVSNKGLPSSIEKTISK AKGQPREPQVCTLPPSQEEMTKNQVSLSCA VKGFYPSDIAVEWESNGQPENNYKTTPPVL DSDGSFFLYSRLTVDKSRMQEGNVFSCSVM HEALHNHYTQKSLSLSLGPG (SEQ ID NO: 298) | |
| DNA669 | Hole: hFc-hCD122 | DKTHTCPPCPAPELLGGPSVFLF PPKPKDTLMISRTPEVTCVVVDV SHEDPEVKFNWYVDGVEVHNAKT KPREEQYNSTYRVVSVLWLHQDW LNGKEYCKVSNKALPAPIEHIS KAKGQPREPQVCTLPPSRDELTK NQVSLSCAVKGFYPSDIAVEWES NGQPENNYKTTPPVLDSDGSFFL VSKLTVDKSRWQQGHNHYTQKSL EALHNHYTQKSLSLSLSPG (SEQ ID NO: 8) | PGSGS (SEQ ID NO: 14) | AVNGTSQFTCFYNSRANISCVW SQDGALQDTSCQVHAWPDRRR WNQTCELLPVSQASWACNLILG APDSQKLITVDIVTLRVLCREGVR WRVMAIQDFKPFENLRLMAPIS LQVHVETHRCNISWEISQASHY FERHLEFARTLSPGHTWEEAPL LTLKQKQEWICLETLTPDTQYEFQ VRVKPLQGEFTTWSPWSQPLAFR TKPAALGKD (SEQ ID NO: 4) |
| DNA670 | Knob: hFc-hIL2 (R38A, F42A, Y45A, E62A, C125A) | DKTHTCPPCPAPELLGGPSVFLFPP KPKDTLMISRTPEVTCVVVDVSHED PEVKFNWYVDGVEVHNAKTKPREEQ YNSTYRVVSVLTVLHQDWLNGKEY KCKVSNKALPAPIEKTISKAKGQPR | GGSSPPG GGSSG GGSGP (SEQ ID NO: 23) | APTSSSTKKTQL QLEHLLLDLQMILNGINNYKNPKL TAMLTAKFAMPKKATELKHLQCL EEALKPLEEVLNLAQSKNFHLRPR DLISNINVIVLELKGSETTFMCEY |

-continued

| | COMPONENT4 SEQUENCE | COMPONENT5 SEQUENCE | |
|---|---|---|---|
| DNA671 | EPQVYTLPPCRDEL TKNQVSLWCL VKGFYPSDIAVEWESNGQPENNYKT TPPVLDSDGSFFLYSKLTVDKSRWQ QGNVFSCSVMHEALHNHYTQKSLSL SPG (SEQ ID NO: 11) | | ADETATIVEFLNRWITFAQSIISTLT (SEQ ID NO: 3) |
| DNA671 Knob: hFc-[VPLSLY]-hIL2 (R38A, F42A, Y45A, E62A, C125A) | DKTHTCPPCPAPELLGGPSVFLFPP KPKDTLMISRTPEVTCVVVDVSHED PEVKFNWYVDGVEVHNAKTKPREEQ YNSTYRVVSVLTVLHQDWLNGKEY KCKVSNKALPAPIEKTISKAKGQPR EPQVYTLPPCRDEL TKNQVSLWCL VKGFYPSDIAVEWESNGQPENNYKT TPPVLDSDGSFFLYSKLTVDKSRWQ QGNVFSCSVMHEALHNHYTQKSLSL SPG (SEQ ID NO: 8) | GSPG (SEQ ID NO: 34) | VPLSLY (SEQ ID NO: 28) |
| DNA672 Hole: hFcIgG4-[VPLSLY]-hCD122 | DKTHTCPPCPAPELLGGPSVFLFP PPKPKDTLMISRTPEVTCVVVDV SHEDPEVKFNWYVDGVEVHNAKT KPREEQYNSTYRVVSVLMLHQDW LNGKEYKCKVSNKALPAPIEHIS KAKGQPREPQVCTLPPSRDELTK NQVSLSCAVKGFYPSDIAVEWES NGQPENNYKTTPPVLDSDGSFFL VSKLTVDKSRWQQGNVFSCSVMH EALHNHYTQKSLSLSPG | GPPSGSSPG (SEQ ID NO: 36) | VPLSLY (SEQ ID NO: 28) |

| NAME | NEW NAMES | COMPONENT4 SEQUENCE | COMPONENT5 SEQUENCE | FULL SEQUENCE |
|---|---|---|---|---|
| DNA158 | Hole: hFc(N297A) | | | DKTHTCPPCPAPELLGGPSVFLFPPKPKDT LMISRTPEVTCVVVDVSHEDPEVKFNWYVD GVEVHNAKTKPREEQYASTYRVVSVLTVLH QDWLNGKEYKCKVSNKALPAPIEKTISKAK GQPREPQVCTLPPSRDELTKNQVSLSCAVK GFYPSDIAVEWESNGQPENNYKTTPPVLDS DGSFFLVSKLTVDKSRWQQGNVFSCSVMHE ALHNHYTQKSLSLSPG (SEQ ID NO: 9) |
| DNA187 | Hole: hFc(N297A)-hCD122 | | | DKTHTCPPCPAPELLGGPSVFLFPPKPKDT LMISRTPEVTCVVVDVSHEDPEVKFNWYVD GVEVHNAKTKPREEQYASTYRVVSVLTVLH QDWLNGKEYKCKVSNKALPAPIEKTISKAK GQPREPQVCTLPPSRDELTKNQVSLSCAVK GFYPSDIAVEWESNGQPENNYKTTPPVLDS DGSFFLVSKLTVDKSRWQQGNVFSCSVMHE |

| | | |
|---|---|---|
| DNA255 | Knob: hFc(N297A)-bIL2(R38A, F42A, Y45A, E62A, C125A) | ALHNHYTQKSLSLSPGPGSGSAVWGTSQFT CFYNSRANISCVWSQDGALQDTSCQVHAWP DRRRMNQTCELLPVSQASWACNLLGAPDS QKLITVDIVTLRVLCREGVRWRVMAIQDFK PFENLRLMAPISLQVVHVETHBCNISWEIS QASHYFERHLE -continued

| | | |
|---|---|---|
| DNA281 | Knob:<br>hFc(N297A)-<br>[DSGGFMLT]-<br>hIL2 (R38A,<br>F42A,<br>Y45A, E62A,<br>C125A) | APTSSSTKKTQLQLEHLLLDLQMILNGINNYKNPKLT<br>AMLTAKFAMPKKATELKHLQCLEEALKPLEEYLNLAQ<br>SKNFHLRPRDLISNINVIVLELKGSETTFMCEYADET<br>ATIVEFLNRWITFAQSIISTLT<br>(SEQ ID NO: 3) | NYKNPKLTRMLTSKFYMPKKATELKHLQCL<br>EEELKPLEEVLNLAQSKNFHLRPPRDLISNI<br>NVIVLELKGSETTFMCEYADETATIVEFLN<br>RWITFAQSIISTLT<br>(SEQ ID NO: 357) |
| | Hole:<br>hFc(N297A)-<br>[DSGGFMLT]<br>SGP (SEQ<br>ID NO:<br>23) | | DKTHTCPPCPAPELLGGPSVFLFPPKPKDT<br>LMISRTPEVTCVVVDVSHEDPEVKFNWYVD<br>GVEVHNAKTKPREEQYASTYRVVSVLTVLH<br>QDWLNGKEYKCKVSNKALPAPIEKTISKAK<br>GQPREPQVTLPPCRDELTKNQVSLWCLVK<br>GFYPSDIAVEWSSNGQPENNYKTTPPVLDS<br>DGSFFLYSKLTVDKSRWQQGNVFSCSVMHE<br>ALKNHYTQKSLSLSPGGSGPDSGGFMLTSG<br>PAFTSSSTKKTQLQLEHLLLDLQMILNGIN<br>NYKKPKLTAMLTAKFAMPKKATELKHLQCL<br>EEALKPLEEVLNLAQSKNFHLRPRDLISNI<br>NVIVLELKGSETTFMCEYADETATIVEFLN<br>RWITFAQSIISTLT<br>(SEQ ID NO: 48) |
| DNA440 | Hole:<br>hFc(N297A)-<br>bCD122<br>(C3122S,<br>C168S) | | DKTHTCPPCPAPELLGGPSVFLFPPKPKDT<br>LMISRTPEVTCVVVDVSHEDPEVKFNWYVD<br>GVEVHNAKTKPREEQYASTYRVVSVLTVLH<br>QDWLNGKEYKCKVSNKALPAPIEKTISKAK<br>GQPREPQVCTLPPSRDELTKNQVSLSCAVK<br>GFYPSDIAVEWSSNGQPENNYKTTPPVLDS<br>DGSFFLVSKLTVDKSRWQQGNVFSCSVMHE<br>ALHNHYTQKSLSLSPGSGSSAVNGTSQFT<br>CFYNSRANLSCVWSQDGALQDTSCQVHAWP<br>DRRRWNQTCELLPVSQASWACNLILGAPDS<br>QKLTTVDIVTLRVLCREGVRWRVMAIQDFK<br>PFENLRLMAPISLQVVHVETHRSNISWEIS<br>QASHYFERHLEFRARTLSPGHTWEEAPLLT<br>LKQKQEWISLETLTPDTQYEFQVRVKPLQG<br>EFTTWSPWSQPLAPRTKPAALGKD<br>(SEQ ID NO: 39) |
| DNA476 | Knob:<br>hFc(N297A)-<br>[NPMGSDP<br>VNFKLLRVV<br>NG]-hIL2<br>(F42S,<br>E62S, C121S,<br>C121S3A) | APTSSSTKKTQLQLEHLLLDLQMI<br>LNGINNYKNPKLTRMLJTSKFYMPK<br>KATELKHLQCLEESLKPLEEVLNL<br>AQSKNFHLRPRDLISNINVIVLEL<br>KGSETTFMCEYADETATIVEFLNR<br>WITFAQSIISTLT(SEQ ID<br>NO: 74) | DKTHTCPPCPAPELLGGPSVFLFPPKPKDTLMISRTPEVT<br>CVVVDVSHEDPEVKFNWYVDGVEVHNAKTKPREEQYASTY<br>RVVSVLTVLHQDWLNGKEYKCKVSNKALPAPIEKTISKAK<br>GQPREPQVVTIPPCRDELTKNQVSLWCLVKGFYPSDIAVE<br>WESNGQPENNYKTTPPVIDSDGSFFLYSKLTVDKSRWQQG<br>NVFSCSVMHEALHNHYTQKSLSLSPG<br>(SEQ ID NO: 360) |
| DNA477 | Knob:<br>mFcIgG2a<br>(LALAPG)-<br>hIL2 (R38A,<br>F42A,<br>Y45A, E62A,<br>C125A) | GP | TIKPCPPCKCPAPNAAGGPSVFIFPPKIKDVLMISLSPIV<br>TCVVVDSEDDPDVQISWFNNVEVHTAQTQTHREDYNST<br>LRVVSALPIQHQDWMSGKEFKCKVNNKDLGAPIERTISKP<br>KGSVRAPQVYVLPCEEEMTKKQVTLWCMVTDFMPEDIYV<br>EWTNNGKTELNYKNTEPVLDSDGSYFMYSKLRVEKKNWVE<br>RNSYSCSVVHEGLHNHHTTKSFSRTPGGGSSPPGGGSSGG<br>GSGAPTSSSTKKTQLQLEHLLLDLQMILNGINNYKNPKL |

| | | |
|---|---|---|
| DNA478 | Knob: mFcIgG2a (LALAPG)-[VPLSLY]-hIL2 (R38A, F42A, Y45A, E62A, C125A) | APTSSSTKKTQL QLEHLLLDLQMI LNGINNYKNPKL TAMLTAKFAMP KKATELKHLQCL EEALKPLEEVLN LAQSKNFHLRPR DLISNINIVLEL KGSETTFMCEY ADETATIVEFLN RWITFAQSIISTL T (SEQ ID NO: 3) SGP (SEQ ID NO: 29) TAMLTAKFAMPKKATELKHLQCLEEALKPLEEVLNLAQSK NFHLRPRDLISNINIVLELKGSETTFMCEYADETATIVE FLNRWITFAQSIISTLT (SEQ ID NO: 361) |
| DNA479 | Hole: mFcIgG2a (LALAPG) | TIKPCPPCKCPAPNAAGGPSVFIFPPKIKDVLMISLSP IVTCVVVDVSEDDPDVQISWFVNNVEVHTAQTQTHRED YNSTLRVVSALPIQHQDWMSGKEFKCKVNNKDLGAPIE RTISKPKGSVRAPQVYVLPPCEEEMTKKQVTLMCMVTD FMPEDIYVEWTNNGKTELNYKNTEPVLDSDGSYFMYSK LRVEKKNWVERNSYSCSLLHEGLHNHHTTKSFSRTPGG SPGVPLSLYSGPAPTSSSTKKTQLQEHLLLDLQMIL NGINNYKNPKLTAMLTAKFAMPKKATELKHLQCLEEA LKPLEEVLNLAQSKNFHLRPRDLISNINIVLELKGS ETTFMCEYADETATIVEFLNRWITFAQSIISTLT (SRQ ID NO: 362) |
| DNA480 | Hole: mFcIgG2a (LALAPG)-hCD122 | TIKPCPPCKCPAPNAAGGPSVFIFPPKIKDVLMISLSPIV TCVVVDVSEDDPDVQISWFVNNVEVHTAQTQTHREDYNST LRVVSALPIQHQDWMSGKEFKCKVNNKDLGAPIERTISKP KGSVRAPQVCVLPPPEEEMTKKQVTLSCAVTDFMPEDIYV EWTNNGKTELNYKNTEPVLDSDGSYFMVSKLRVEKKNWVE RNSYSCVVHEGLHNHHTTKSFSRTPG (SEQ ID NO: 281) AVNGTSQFTCFYNSRANISCVW SQDGALQDTSCQVHAWPDRRR WNQTCELLPVSQASWACNLILG APDSQKLTTVDIVTLRVLCREGVR WRVMAIQDFKPFENLRLMAPIS LQVHVETHRCNISWEISQASHY FERHLEFEARTLSPGHTWEEAPL LTLKQEWICLETLTPDTQYEFQ TIKPCPPCKCPAPNAAGGPSVFIFPPKIKDV LMISLSPIVTCVVVDVSEDDPDVQISWFVN NVEVHTAQTQTHREDYNSTLRVVSALPIQH QDMMSGKEFKCKVNNKDLGAPIERTISKPK GSVRAPQVCVLPPPEEEMTKKQVTLSCAVT DFMPEDIYVEWTNNGCTELNYKNTEPVLDS DGSYFMVSKLRVEKKNWVERNSYSCSWHEG LKNHHTTKSFSRTPGPGSGSAVNGTSQFTC FYNSRANISCVVVSQDGALQDTSCQVHAWP DRRRWNQTCELLPVSQASWACNLLIGAPDS QKLTTVDIVTLRVLCREGVRWRVMAIQDFK PFENLRLMAPISLQWHVETHRCNISWEISQ ASHYFERHLEFEARTLSPGHTWEEAPLLTL KQKQEWICLETLITPDTQYEFQVRVKPLQGE FTTWSPVVSQPLAFRTKPAALGKD (SEQ ID NO: 363) |
| DNA516 | F8ScFvVersion1-Hole: hFc(N297A)-hCD122 | PGSGS (SEQ ID NO: 14) EVQLLESGGGLVQPGGSLRLSCAASGFTFSL FTMSVVVRQAPGKGLEVVVSAISGSGGSTY YADSVKGRFTISRDNSKNTYLQMNSLRAED TAVYYCAKSTHLYLFDYWGQGTLVTVSSGG GGSGGGGEIGGGSEIVLTQSPGTLSISPG ERATLSCRASQSVSMPFLAWYQQKPGQAPR LLIYGASSRATGIPDRESGSGSGTDFTLTI SRLEPEDFAVYYCQQMRGRPPTFGQGTKVE |

| | | -continued |
|---|---|---|
| | | VRVKPLQGEFTTWSPWSQPLAFR<br>TKPAALGKD<br>(SEQ ID NO: 4) |
| DNA520 | Hole:<br>mFcIgG2a<br>(LALAP<br>G) -<br>No<br>AnnototationFound | IKGGSDKTHTCPPCPAPELLGGPSVFLPPP<br>KPKDTLMISRTPEVTCVVVDVSHEDPEVKF<br>NWYVDGVEVHNAKTKPREEQYASTYRVVSV<br>LTVLHQDWLNGKEYKCKVSNKALPAPIEKT<br>ISAKGQPREPQVCTLPPSRDELTKNQVSL<br>SCAVKGFYPSDIAVEWESNGQPENNYKTTP<br>PVLDSDGSFFLVSKLTVDKSRWQQGNVFSC<br>SVMHEALHNHYTQKSLSLSPGPGSGSAVNG<br>TSQFTCFYNSRANISCVWSQDGALQDTSCQ<br>VHAWPDRRRWMNQTCELLPVSQASWACNLIL<br>GAPDSQKLTTVDIVTLRVLCREGVRWRVMA<br>IQDFKPFENLRLMAPISLQVVHVETHRCNI<br>SWEISQASHYFERHLEFEARTLSPGHTWEE<br>APLLTLKQQEWICLETLTPDTQYEFQVRV<br>KPLQGEFTTWSPWSQPLAFRTKPAALGKD<br>(SEQ ID NO: 364) |
| DNA521 | Hole:<br>hFcIgG2a<br>(LALAP<br>G) -<br>No<br>AnnototationFound | GHHHH<br>HHHH<br>(SEQ<br>ID<br>NO:<br>334) | TIKPCPPCKCPAPNAAGGPSVFIFPPKIKDV<br>LMLSLSPIVTCVVVDVSEDDPDVQISWFVN<br>NVEVHTAQTQTHREDYNSTLRVVSALPIQH<br>QDVVMSGKEFKCKVNNKDLGAPIERTISKP<br>KGSVRAPQVCVLPPPEEEMTKKQVTLSCAV<br>TDFMPEDIYVEWTNNGKTELNYKMTEPVLD<br>SDGSYFMVSKLRVEKKNWVERNSYSCSVVH<br>EGLHNHHTTKSFSRTPGHHHHHHHH<br>(SEQ ID NO: 365) |
| DNA522 | Hole:<br>mFcIgG2a<br>(LALAP<br>G) -<br>No<br>AnnototationFound | GHHHH<br>HHHH<br>(SEQ<br>ID<br>NO:<br>334) | TIKPCPPCKCPAPNAAGGPSVFIFPPKIKDV<br>LMISISPIVTCVVVDVSEDQPDVQISWFVN<br>NVEVHTAQTQTHREDYNSTLRWSALPIQHQ<br>PWMSGKEFKCKVNNKDLGAPIERTISKPKG<br>SVRAPQVCVLPPPEEEMTKKQVTLSCAVTD<br>FMPEDIYVEWTNNGKTELNYKNTEPVLDSD<br>GSYPMVSKLRVEKKNWVERNSYSCSVVHEG<br>LHNHHTTKSFSRTPGPGSGSAVNGTSQFTC<br>FYNSRANISCVWSQDGALQDTSCQVHAWPD<br>RRRWMNQTCELLPVSQASVVACNLILGAPDS<br>QKITTVDIVTLRVICREGVRWRVMAIQDFK<br>PFENLRLMAPISLQWHVETHRCNISW<br>EISQASHYFERHLEFEARTLSPGHTWEEAP<br>ILTLKQQEWICLETLTPDTQYEFQVRVKP<br>LQGEFTTWSPWSQPLAFRTKPAALGKDGHH<br>HHHHHH<br>(SEQ ID NO: 366) |
| DNA522 | | | TIKPCPPCKCPAPNAAGGPSVFIFPPKIKDV<br>LMISLSPIVTCVVVDVSEDDPDVQISWFVN<br>NVEVHTAQTQTHREDYNSTLRWSALPIQHQ<br>DWMSGKEFKCKVNNKDLGAPIERTISKPKG<br>SVRAPQVCVLPPPEEEMTKKQVTLSCAVTD<br>FMPEDIYVEWTNNGKTELNYKNTEPVLDSD<br>GSYPMVSKLRVEKKNWVERNSYSCSVVHEG<br>LHNHHTTKSFSRTPGPGSGSAVKNCSHLEC |

-continued

| | | |
|---|---|---|
| DNA528 | Hole: hFc(N297A)-hCD122 (C168S) | FYNSRANVSCMWSHEEALNVTTCHVHAKSN LRHWNKTCELTLVRQASWACMLIIGSFPES QSLTSVDLLDINVCWEEKGWRRVKTCDFH PFDNLRLVAPHSLQVLHIDTQRCNISWKVS QVSHYIEPYLEFARRRLLGHSWEDASVLS LKQRQQWLFLEMLIPSTSYEVQVRVKAQRN NTGTWSPWSQPLTFRTRPADPMKEGHHHHH HHH (SEQ ID NO: 367) |
| | | DKTHTCPPCPAPELLGGPSVFLFPPKPKDT LMISRTPEVTCVVVDVSHEDPEVKFNWYVD GVEVHNAKTKPREEQYASTYRVVSVLTVLH QDWLNGKEYKCKVSNKALPAPIEKTISKAK GQPREPQVCTLPPSRDELTKNQVSLSCAVK GFYPSDIAVEWESNGQPENNYKTTPPVLDS DGSFFLV |
| | | SKLTVDKSRWQQGNVFSCSVMHEALHNHYT QKSLSLSPGSGSSAVNGTSQFTCFYNSRA NISCVWSQDGALQDTSCQVHAWPDRRRWNQ TCELLPVSQASWACNLILGAPDSQKLTTVD IVTLRVLCREGVRWRVMAIQDFKPFENLRL MAPISLQWHVETHRCNISWEIFQASHYFER HLEFEARTLSPGHTWEEAPLLTLKQKQEWI SLFIITPDTQYEFQVRVKPLQGEFTTWSPW SQPLAFRTKPAALGKD (SEQ ID NO: 368) |
| DNA530 | Knob: mFcIgG1 (DAPG)-hIL2 (R38A, F42A, Y45A, E62A, C125S) | VRSGCKPCICTVPEVSSVRFPPPKDVLTI TLTPKVTCVVVAISKDDPEVQFSWFVDDVE VHTAQTQPREEQFNSTFRSVSELPIMHQDW LNGKEFKCRVNSAAFGAPIEKTISKTGRP KAPQVYTIPPPKEQMAKDKVSLTCMITDFF PEDITVEWQMNGQPAENYDNTQPIMDTDGS YFVYSDLNVQKSNWEAGNTFTCSVLHEGLH NHHTEKSLSHSPGGGSSPPGGGSSGGGSGP APTSSSTKKTQLQLEHLLLDLQMILNGINN YKNPKLTAMLTAKFAMPKKATELKHLQCLE EALKPLEEVLNLAQSKNFHLRPRDLISNIN VIVLELKGSETTFMCEYADETATIVEFLNR WITFAQSSISTLT (SEQ ID NO: 369) |
| DNA531 | Knob: mFcIgG1 (DAPG)-[VPLSLY] hIL2 (R38A, F42A, Y45A, | VRSGCKPCICTVPEVSSVFIFPPKPKDVLTI ITLTPKVTCVVVAISKDDPEVQFSWFVDDV EVHTAQTQPREEQFNSTFRSVSELPIMHQD WLNGKEFKCRVNSMFGAPIEKTISKTGRP KAPQVYTIPPPKEQMAKDKVSLTCMITDFF PEDITVEWQMNGQPAENYDNTQPIMDTDGS YFVYSDLNVQKSNWEAGNTFTCSVLHEGLH NHHTEKSLSHSPGGSPGVPLSLYSGPAPTS APTSSSTKKTQL QLEHLLLDLQMI LNGINNYKNPKL TAMLTAKFAMP KKATELKHLQCL EEALKPLEEVLN LAQSKNFHLRPR DLISNINVIVL |
| | SGP (SEQ ID NO: 29) | |

| | | |
|---|---|---|
| | E62A, C125S) | ELKGSETTFMC EYADETATIVEF LNRWITFAQSII STLT (SEQ ID NO: 3) | SSTKKTQLQLEHLILDIQMILNGINNYKNP KLTAMLTAKFAMPKKATELKHLQCLEEALK PLEEVLIMLAQSKNFHLRPRDLISNIVIVL ELKGSETTFMCEYADETATIVEFLNRWSTF AQSIISTLT (SEQ ID NO: 370) |
| DNA532 | Hole: mFcIgG1 (DAPG) | | VRSGCKPCICTVPEVSSVFIFPPKPKDVLH TLIPKVTCVVVAISKDDPEVQFSWFVDDVE VHTAQTQPREEQFNSTFRSVSELPIMHQDW LNGKEFKCRVNSAAFGAPIEKTISKTKGRP KAPQVYTIPPPKKQMAKDKVSLTCMITDFF PEDITVEWQWNGQPAENYKNTQPIMKTDGS YFWSKLNVQKSNWEAGNTFTCSVLHEGLHN HHTEKSLSHSPG (SEQ ID NO: 284) |
| DNA533 | Hole: mFcIgG1 (DAP G)- hCD122 | | VRSGCKPGCTVPGVSSVFIFPPKPKDVLTI TLIPKVTCVVVAISKDDPEVQFSWFVDDVE VHTAQTQPREEQFNSTFRSVSELPIMHQDW LNGKEFKCRVNSAAFGAPIEKTISKTKGRP KAPQVYTIPPPKKQPMAKDKVSLTCMITDF FPEDITVEWQWNGQPAENYKNTQPIMKTDG SYFVYSKLNVQKSNWEAGNTFTCSVLHEGL HNHHTEKSLSHSPGPGSGSAVNGTSQFTCF YNSRANISCVWSQPGALQPTSCQVHAWPDR RRWNQTCELLPVSQASWACNLILGAPDSQK LTTVDIVTLRVLCREGVRWRVMAIQDFKPF ENLRLMAPISLQVHVETHRCNISWEISQAS HYFERHLEFEARTLSPGHTWEEAPLLTLKQ KQEWICLETLTPDTQYEFQVRVKPLQGEFT TTWSPWSQPLAFRTKPAALGKD (SEQ ID NO: 371) |
| DNA534 | Hole: mFcIgG1 (DAP G)- mCD122 | | VRSGCKPCICTVPEVSSVFIFPPKPKDVLT ITLTPKVTCVWAISKDDPEVQFSWFV DDVEVHTAQTQPREEQFNSTFRSVSELPIM HQDWLNGKEFKCRVNSAAFGAPIE KTISKTKGRPKAPQVYTIPPPKKQMAKDKV SLTCMITDFFPEDITVEWQWNGQP AENYKNTQPIMKTDGSYFVYSKLNVQKSNW EAGNTFTCSVLHEGLHNHHTEKSL SHSPGPGSGSAVKNCSHLECFYNSRANVSC MWSHEEALNVTTCHVHAKSNLRH WNKTCELTLVRQASWACNLILGSFPESQSL TSVDLLOINMCWEEKGWRRVKTC DFHPFDNLRLVAPHSLQVLHIDTQRCNISW KVSQVSHYIEPYLEFEARRRLLGHS WEDASVLSLKQRQVVLFLEMLIPSTSYEV QVRVKAQRNNTGTWSPWSQPLTFR TRPADPMKE (SEQ ID NO: 372) |

| | | | |
|---|---|---|---|
| DNA542 | Knob: hFc(N297A)-hIL2(R38A, F42A, Y45A, E62A, C125A) | | DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSGLLSGRSDQPSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT (SEQ ID NO: 373) |
| DNA543 | Hole: hFc(N297A)-[VPLsLY]-hCD122 | GSGGG (SEQ ID NO: 31) | AVNGTSQFTCFYNSRANISCVWSQDGALQDTSCQVHAWPDRRRWNQTCELLPVSQASWACNLILGAPDSQKLTTVDIVTLRVLCREGVRMRVMAIQDFKPFENLRLMAPISLQVVHETHRCNISWEISQASHYFERHLEFEARTLSPGHTWEEAPLLTLKQKQEWICLETLTPDTQYEFQVRVKPLQGEFTTWSPWSQPLAFRTKPAALGKD (SEQ ID NO: 4) | DKTHTCPPCPAPELLGGPSVFLFPPKPKDTLMISRTPEVTCVVVDVSHEDPEVKFNWWDGVEVHNAKTKPREEQYASTYRVVSVLWLHQDWLNGKEYKCKVSNKALPAPIEKTISKAKGQPREPQVCTLPPSRDELTKNQVSLSCAVKGPYPSDIAVEWESNGQPENNYKTTPPVLDSDGSFFLVSKLTVDKSRWQQGNVFSCSVMHEALHNHYTQKSLSLSPGGPPSGSSPGVPLSLYGSQGGAVNGTSQFTCFYNSRANISCWSQDGALQDTSCQVHAWPDRRRWNQTCELLPVSQASWACNLILGAPDSQKLTTVDIVTLRVLCREGVRMRVMAIQDFKPFENLRLMAPISLQVVHVETHRCNISWEISQASHYFERHLEFEARTISPGHTWEEAPLLLIKQKQEWICLETITPDTQYEFQVRVKPLQGEFTTWSPWSQPLAFRTKPAALGKD (SEQ ID NO: 42) |
| DNA544 | Knob: hFc(N297A)-[VPLsLY]-hIL2 (R38A, F42A, Y45A, E62A, L80F, R81D, L85V, I36V, I92F, C125A) | SGP (SEQ ID NO: 29) | APTSSSTKKTQLQLEHLLLDLQMILNGINNYKNPKLTAMLTAKFAMPKKATELKHLQCLEEALKPLEEVLNLAQSKNFHFDPRDWSNIMVFVLSIKGSETTFMCEYADETATIVEFLNRWITFAQSIISTIT (SEQ ID NO: 328) | DKTHTCPPCPAPELLGGPSVFLFPPKPKDTLMISRTPEVTCVVVDVSHEDPEVKFNWYVDGVEVHNAHTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVQKSRWQQGNVPLSLYSGPAPTSSSTKKTQLQLEHLLLDLQMINGINNYKNPKLTAMLTAKFAMPKKATELKHLQCLEEALKPLEEVLNLAQSKNFHFDPRDWSNINVFVLELKGSETTFMCEYADETATIVEFLNRWITFAQSIISTLT (SEQ ID NO: 375) |
| DNA545 | Knob: hFc | | | DKTHTCPPCPAPELLGGPSVFLFPPKPKDTLMISRTPEVTCVVVDVSHEDPEVKFNWYVDG |

| | | |
|---|---|---|
| | (N297A)-<br>hIL2<br>(R38A,<br>F42A,<br>Y45A,<br>E62A,<br>C125A) | VEVHNAKTKPREEQYASTYRVVSVLTVLHQ<br>PWLNGKEYKCKVSNKALPAPIEKHSKAKGQ<br>PRGPQVYTIPPCRDELTKNQVSLWCIVKGF<br>YPSDIAVEWESNGQPENNYKTTPPVLDSDG<br>SFFLYSKLTVDKSRWQQGNVFSCSVMHEAL<br>HNHYTQKSLSLSPGISSGLLSGRSSGPAP<br>TSSSTKKTQLQLEHLLLDLQMILNGINNYK<br>NPKLTAMLTAKFAMPKKATELKHLQCLEEA<br>LKPLEEVLNLAQSKNFHLRPRDLISNINVI<br>VLELKGSETTFMCEYADETATIVEFLNRWI<br>TFAQSIISTLT(SEQ ID NO: 376) |
| DNA546 | Knob:<br>hFc<br>(N297A)-<br>hIL2<br>(R38A,<br>F42A,<br>Y45A,<br>E62A,<br>L30F,<br>R81D,<br>I85V,<br>I86V,<br>I32F, C125A) | DKTHTCPPCPAPELLGGPSVFLFPPKPKDT<br>LMISRTPEVTCVVVDVSHEDPEVKFNWYV<br>DGVEVHNAKTKPREEQYASTYRMWSVLTVLH<br>QDWINGKEYKCKVSNKALPAPIEKTISKAK<br>GQPREPQVYTLPPCRDELTKNQVSLWCLVK<br>GFYPSDIAVEWESNGQPENNYKTTPPVLDS<br>DGSFFLYSKLTVQKSRWQQGNVFSCSVMHE<br>ALHNHYTQKSLSLSPGGGSSPPGGGSSGG<br>GSGAPTSSSTKKTQLQLEHLLLDLQMILN<br>GINNYKNPKLTAMLTAKFAMPKKATELKH<br>LQCLEEALKPLEEVLNLAQSKNFHPDPRDV<br>VSNINVFVLELKGSETTFMCEYADETATIV<br>EFLNRWITFAQSHSTLT<br>(SEQ ID NO: 377) |
| DNA547 | Hole:<br>hFcIgG1<br>(N29<br>7A + EPKSS)-<br>Hole:<br>hFc<br>(N297A)-<br>hCD122 | AVNGTSQFTCFYNSRANISCVW<br>SQDGALQDTSCQVHAWPDRRR<br>WNQTCELLPVSQASWACNLILG<br>APDSQKLTTVDIVTLRVLCREGVR<br>WRVMAIQDFKPFENLRLMAPIS<br>LQVHVETHRCNISWEISQASHY<br>FERHLEFEARTLSPGHTWEEAPL<br>LTLKQKQEMICLETLTPDTQYEFQ<br>VRVKPLQGEFTTWSPWSQPLAFR<br>TKPAALGKD<br>(SEQ ID NO: 4) | EPKSSDKTHTCPPCPAPELLGGPSV<br>FLFPPKPKDTLMISRTPEVTCVVVD<br>VSHEDPEVKFNWYVDGVEVHNAKTK<br>PREEQYASTYRVVSVLTVLHQDMLN<br>GKEYKCKVSNKALPAPIEKTISKAK<br>GQPREPQVCLPPSRDELTKNQVSLS<br>CAVKGFYPSDIAVEWESNGQPENNY<br>KTTPPVLDSDGSFFLVSKLTVCKSR<br>WQQGNVFSCSVMHEALHNHYTQKSL<br>SLSPGGSGSGAVNGTSQFTCFYMSR<br>ANISCVWSQDGALQDTSCQVHAWPD<br>RRRWNQTCELLPVSQASWACNLILG<br>APDSQKLTTVDIVTLRVLCREGVRW<br>RVMAIQDFKPFENLRLMAPISLQWH<br>VETHRCNISWEISQASHYFERHLEF<br>EARTLSPGHTWEEAPLLTLKQKQEW<br>ICLETLTPDTQYEFQVRVKPLQGEF<br>FTWSPWSQPLAFRTKPAALGKD<br>(SEQ ID NO: 378) |
| DNA548 | Hole:<br>hFcIgG1<br>(N29<br>7A + AK7)-<br>Hole:<br>hFc | AVNGTSQFTCFYNSRANISCVW<br>SQDGALQDTSCQVHAWPDRRR<br>WNQTCELLPVSQASWACNLILG<br>APDSQKLTTVDIVTLRVLCREGVR<br>WRVMAIQDFKPFENLRLMAPIS<br>LQVHVETHRCNISWEISQASHY | AKTDKTHTCPPCPAPELLGGPSVFL<br>FPPKPKDTLMISRTPEVTCVVVDVS<br>HEDPEVKFNWYVDGVEVHNAKTKPR<br>EEQYASTYRVVSVLTVLHQDWLNGK<br>EYKCKVSNKALPAPIEKTISKAKGQ<br>PREPQVCLPPSRDELTKNQVSLSC |

| | | |
|---|---|---|
| | (N297A) - hCD122 | FERHLEFEARTLSPGHTWEEAPL LTLKQKQEWICLETLTPDTQYEFQ VRVKPLQGEFTTWSPWSQPLAFR TKPAALGKD (SEQ ID NO: 4) | AVKGFYPSDIAVEWESNGQPENNYK TTPPVLDSDGSFFLVSKLTVDKSRW QQGNVFSCSVMHEALHNHYTQKSLS LSPGPGSGSAVNGTSQFTCFYNSRA NISCVWSQDGALQDTSCQVHAWPDR RRMNQTCELLPVSQASWACNLILGA PDSQKLTTVDIVTLRVLCREGVRWR VMAIQDFKPPENLRLMAPISLQVVH VETHRCNISWEISQASHYFERHLEF EARTLSPGHTWEEAPLLTLKQKQEW ICLETLTPDTQYEFQVRVKPLQGEF TTWSPWSQPLAFRTKPAALGKD (SEQ ID NO: 379) |
| DNA549 | Knob: hFcIgG1 (N29 7A + AKTEPKSS) - hCD122 | PGSGS (SEQ ID NO: 14) AVNGTSQFTCFYNSRANISCVWS SQDGALQDTSCQVHAWPDRRR WNQTCELLPVSQASWACNLILG APDSQKLTTVDIVTLRVLCREGVR WRVMAIQDFKPPENLRLMAPIS LQVVHVETHRCNISWEISQASHY FERHLEFEARTLSPGHTWEEAPL LTLKQKQEWICLETLTPDTQYEFQ VRVKPLQGEFTTWSPWSQPLAFR TKPAALGKD (SEQ ID NO: 4) | AKTEPKSSDKTHTCPPCPAPELLGG PSVFLFPPKPKDTLMISRTPEVTCV VVDVSHEDPEVKFNWYVDGVEVHNA KTKPREEQYASTYRVVSVLTVLHQD WLNGKEYKCKVSNKALPAPIEKTIS KAKGQPREPQVCTLPPSRDEITKNQ VSLSCAVKGFYPSDIAVEWESNGQP ENNYKTTPPVLDSDGSFFLVSKLTV DKSRWQQGNVFSCSVMHEALHNHYT QKSLSLSPGPGSGSAVNGTSQFTCF YNSRANISCVWSQDGALQPTSCQVH AWPDRRRWNQTCELLPVSQASWACN LILGAPDSQKLTTVDIVTLRVLCRE GVRWRVMAIQDFKPPENLRLMAPIS LQWHVETHRCNISWEISQASHYFER HLEFEARTLSPGHTWEEAPLLTLKQ KQEWICLETLTPDTQYEFQVRVKPL QGEFTTWSPWSQPLAFRTKPAALGK D (SEQ ID NO: 380) |
| DNA550 | Knob: hFcIgG1 (N29 7A + EPKSS) - hIL2 (R38A, F42A, Y45A, E62A, C125A) | SGP (SEQ ID NO: 29) APTSSSTKKTQL QLEHLLLDLQMI LNGINNYKNPKL TAMLTAKFAMP KKATELKHLQCL EEALKPLEEVLN LAQSKNFHLRPR DLISNINIVLEL KGSETTFMCEY ADETATIVEFLN RWITFAQSIISTL T (SEQ ID NO: 3) | EPKSSDKTHTCPPCPAPELLGGPVF LFPPKPKDTLMISRTPEVTCVVVDV SHEDPEVKFNWY VDGVEVHNAKTKPREEQYASTFYRV VSVLTVLHQDWLNGKEYKCKVSNKA LPAPIEKTISKAKGQPREPQVYTLP PCRDELTKNQVSLWCLVKGFYPSDI AVEWESNGQPENNYKTTPPVLDSDG SFFLYSKLTVDKSRWQQGNVFSCSV MHEALHNHYTQKSLSLSPGGSPGVP LSLYSGPAPTSSSTKKTQLQLEHLL LDLQMILNGINNYKNPKLTAMLTAK FAMPKKATELKHLQCLEERALKPLEE VLNLAQSKNFHLRPRDLISNINVIV LELKGSETTFMCEYADETATIVEFL NRWITFAQSIISTLT (SEQ ID NO: 381) |

-continued

| | | | |
|---|---|---|---|
| DNA551 | Knob: hFcIgG1 (N29 7A + AKT)-[VPLSLY] hIL2 (R38A, F42A, Y45A, E62A, C125A) | SGP (SEQ ID NO: 29) | APTSSSTKKTQL QLEHLLLDLQMI LNGINNYKNPKL TAMLTAKFAMP KKATELKHLQCL EEALKPLEEVLN LAQSKNFHLRPR DLISNINVIVLEL KGSETTFMCEY ADETATIVEFLN RWITFAQSIISTL T (SEQ ID NO: 3) | AKTDKTHTCPPCPAPELLGGPSVFL FPPKPKDTLMISRTPEVTCVVVDVS HEDPEVKFNWYVDGVEVHNAKTRPR EEQYASTYRVVSVLTVLHQDWLNGK EVKCKVSNKALPAPIEKTISKAKGQ PREPQVYTLPPCRDELTKNQVSLWC LVKGFYPSDIAVEWESNGQPENNYK TTPPVLDSDGSFFLYSKLTVDKSRW QQGIWFSCSVMHEALHNHYTQKSLS LSPGGSPGVPLSLYSGPAPTSSSTK KTQLQLEHLLLDLQMILNGINNYKN PKLTAMLTAKFAMPKKATELKHLQC LEEALKPLEEVLNLAQSKNFHLRPR DLISNINVIVLELKGSETTFMCEYA DETATIVEFLNRWITFAQSIISTLT (SEQ ID NO: 382) |
| DNA552 | Knob: hFcIgG1 (N29 7A + AKTEPKSS)-[VPLSLY] hIL2 (E15R, L18C, D20R, R38A, F42A, Y45A, E62A, N88L) | SGP (SEQ ID NO: 29) | APTSSSTKKTQL QLEHLLLDLQMI LNGINNYKNPKL TAMLTAKFAMP KKATELKHLQCL EEALKPLEEVLN LAQSKNFHLRPR DLISNINVIVLEL KGSETTFMCEY ADETATIVEFLN RWITFAQSIISTL T (SEQ ID NO: 3) | AICTEPKSSDKTHTCPPCPAPELLG GPSVFLFPPKPKDTLMISRTPEVTC VVVDVSHEDPEVKFNWYVDGVEVHN AKTKPREEQYASTYRVVSVLTVLHQ DWLNGKEYKCKVSNKALPAPIEKLIS KAKGQPREPQVYTLPPCRDELTKNQ VSLWCLVKGFYPSDIAVEWESNGQP ENNYKTTPPVLDSDGSFFLYSKLTV DKSRWQQGSNVFSCSVMHEALHNHYT QKSLSLSPGGSPGVPLSLYSGPAPT SSSTKKTQLQLEHLLLDLQMILNGI NNYKNPKLTAMLTAKFAMPKKATEL KHLQCLEEALKPLEEVLNLAQSKNF HLRPRDLISNINVIVLELKGSETTF MCEYADETATIVEFLNRWITFAQSI STLT (SEQ ID NO: 383) |
| DNA553 | Hole(N297A): hFc(N297A)-[DSGGFMLT]-hCD122 | SGGG (SEQ ID NO: 30) | AVNGTSQFTCFYNSRANISCVW SQDGALQDTSCQVHAWPDRRR WNQTCELLPVSQASWACNLILG APDSQKLTTVDIVTLRVLCREGVR WRVMAIQDFKPFENLRLMAPIS LQVVHVETHRCNISWEISQASHY FERHLEFEARTLSPGHTWEEAPL LTLKQKQEWICLETLITPDTQYEFQ VRVKPLQGEFTTWSPWSQPLAFR TKPAALGKD (SEQ ID NO: 4) | DKTHTCPPCPAPELLGGPSVFLFPPKPKDTL MISRTPEVTCVVLMSHEDPEVKFNWYVDG VEVHNAKTKPREEQYASTYRVVSVLTVLHQ DWLNGKEYKCKVSNKALPAPIEKTISKAKG QPREPQVCTLPPSRDELTKNQVSLSCAVKG FYPSDIAVEWESNGQPENNYKTTPPVLDSD GSFFLVSKLTVDKSRWQQGNVFSCSVMHEA LHNHYTQKSLSLSPGGPPSGSSPGDSGGFM LTSGGGAVNGTSQFTCFYNSRANISCVWSQ DGALQDTSCQVHAWPDRRRWNQTCELLPVS QASWACNLILGAPDSQKLTTVDIVTLRVLC REGVRWRVMAIQDFKPFENLRLMAPISLQV VHVETHRCNISWEISQASHYFERHLEFEAR TLSPGHTWEEAPLLTLKQKQEWICLETLTP DTQYEFQVRVKPLQGEFTTWSPWSQPLAFR TKPAALGKD (SEQ ID NO: 41) |

| | | -continued | |
|---|---|---|---|
| DNA554 | Knob: hFc(N297A)- [VPLSLY]- hIL2 (E15R, L18C, D20R, R38A, F42A, Y45A, E62A) | APTSSSTKKTQL QLRHLCLRLQMI LNGINNYKNPKL TAMLTAKFAMP KKATELKHLQCL EEALKPLEEVIN LAQSKNFHLRPR DLISNINIVLEL KGSETTFMCEY ADETATIVEFLN RWITFCQSIISTL T (SEQ ID NO: 339) | DKTHTCPPCPAPELLGGPSVFLFPPKPKDT LMISRTPEVTCVVVDVSHEDPEVKFNWYVD GVEVHNAKTKPREEQYASTYRVVSVITVLH QDWLNGKEYKCKV SNKALPAPIEKTISKAKGQPREPQVYTLPP CRDELTKNQVSLWCLVKGFYPSDIAVEWES NGQPENNYKTTPPVLDSDGSFFLYSKLTVD KSRWQQGNVFSCSVMHEALHNHYTQKSLSL SPGGSPGVPLSLYSGPAPTSSSTKKTQLQL RHLCLRLQMILNGINNYKNPKLTAMLTAKF AMPKKATELKHLQCLEEALKPLEEVLNLAQ SKNFHLRPRDLISNINIVLELKGSETTFM CEYADETATIVEFLNRWITFCQSIISTLT (SEQ ID NO: 385) |
| DNA563 | Knob: hFcIgG1 (N297A) [VPLSLY]- hIL2 (R38A, F42A, Y45A, E62A, C125A) | APTSSSTKKTQLQL RHLCLSLQMILNGI NNYKNPKLTAMLTA KFAMPKKATELKH LQCLEEALKPLEEV LNLAQSKNFHLRPR DLISLINIVLELK GSETTFMCEYADETA TIVEFLNRWITFCQS IISTLT (SEQ ID NO: 340) | DKTHTCPPCPAPELLGGPSVFLFPPK PKDTLMISRTPEVTCVVVDVSHEDP EVKFNWYVDGVEVHNAKTKPREEQY ASTYRVVSVLWLHQDWLNGKEYCK VSNKALPAPIEKTISKAKGQPREPQ VYTLPPCRDELTKNQVSLWCLVKGF YPSDIAVEWESNGQPENNYKTTPPV IDSDGSFFLYSKLMDKSRVYQQGNV FSCSVMHEALHNHYTQKSLSLSPGG SPGVPLSLYSGPAPTSSSTKKTQLQ LRMLCLRLQMILNGINNYKNPKLTA MLTAKFAMPKKATELKHLQCLEEAL KPLEEVLNLAQSKNFHLRPRDLISL INVIVLELKGSETTFMCEYAOETAT IVEFLNRWITFCQSIISTLT (SEQ ID NO: 386) |
| DNA565 | Knob: hFc (N297A) [VPLSLY]- hIL2 (E15R, L18C, D20R, R38A, F42A, Y45A, E62A, N88L) | APTSSSTKKTQL QLHHLCLRLQMI LNGINNYKNPKL TAMLTAKFAMP KKATELKHLQCL EEALKPLEEVLN LAQSKNFHLRPR DLISLINIVLE LKGSETTFMCEY ADETATIVEFLN RWITFCQSIISTLT (SEQ ID NO: 341) | DKTHTCPPCPAPELLGGPSVFLFPPK PKDTLMISRTPEVTCVVVDVSHEDP EVKFNWYVDGVEVHNAKTKPREEQY ASTYRVVSVLWLHQDWLNGKEYCK VSNKALPAPIEKTISKAKGQPREPQ VCTLPPCRDELTKNQVSLWCLVKGF YPSDIAVEWESMGQPENNYKTTPPV LDSDGSFFLYSKLTVDKSRWQQGNV FSCSVMHEALHNHYTQKSLSLSPGG SPGVPLSLYSGPAPTSSSTKKTQLQ LLHLCLRLQMILNGINNYKNPKLTA MLTAKFAMPKKATELKHLQCLEEAL KPLEEVLNLAQSKNFHLRPRDLISL INVIVLELKGSETTFMCEYADETAT IVEFLNRWITFCQSIISTLT (SEQ ID NO: 387) |
| DNA566 | Knob: hFc (N297A) - [VPLSLY] | APTSSSTKKTQL QLRHLCLDLQM ILNGINNYKNPK LTAMLTAKFAM | DKTHTCPPCPAPELLGGPSVFLFPPK PKDTLMISRTPEVTCVCDVSHEDP EVKFNWYVDGVEVHNAKTKPREEQY ASTYRVVSVLTVLHQDWLNGKEYC |

-continued

| | | |
|---|---|---|
| | hIL2 (E15R, L18C, R38A, F42A, Y45A, E62A, N88L) | PKKATELKHLQC LEEALKPLEEVL NLAQSKNFHLR PRDLISLINVIVL ELKGSETTFMCE YADETATIVEFL NRWITFCQSIIS TLT (SEQ ID NO: 342) | KVSNKALPAPIEKTISKAKGQPREP QVYTLPPCRDELTKMQVSLWCLVKG FYPSDIAVEWESNGQPENNYKTTPP VLDSDGSFFLYSKLTVDKSRWQQGN VFSCSVMHEALHNHYTQKSLSLSPG GSPGVPLSLYSGPATSSSTKKTQL QLRHLCLDLQMILMGINNNYKNPKLT AMLTAKFAMPKKATELKHLQCLEEA LKPLEEVLNWQSKNFHLRPRDLISL INVIVLELKGSETTFMCEYADETAT IVEFLNRVVITFCQSIISTLT (SEQ ID NO: 388) |
| DNA565 | Knob: hFc (N297A) [VPLSLY]- hIL2 (L18C, D20R, R38A, F42A, Y45A, E62A, N88L) | APTSSSTKKTQL QLEHLCLRLQMI LNGINNYKNPKL TAMLTAKFAMP KKATELKHLQCL EEALKPLEEVLN LAQSKNFHLRPR DLISLINIVLEL KGSETTFMCEYA DETATIVEFINR WITFCQSIISTLT (SEQ ID NO: 343) | DKTHTCPPCPAPELLGGPSVFLFP PKPKDTLMISRTPE VTCVVVDVSHEOPEVKFNWYVDGVE VHNAKTKPREEQYASTYRVVSLITV LHQDWLNGKEYKCKVSNKALPAPIE KTISKAKGQPREPQVYTLPPCRDEL TKMQVSLWCLVKGFYPSDIAVEWES NGQPENNYKTTPPVLDSDGSFFLYS KLTVDKSRWQQGNVFSCSVMHEALH NHYTQKSLSLSPGGSPGVPLSLYSG PAPTSSSTKICTQLQLEHLCLRLQM ILNGINNYKNPKLTAMLTAKFAMPK KATELKHLQCLEEALKPLEEVNLA QSKNFHLRPRDLISLINVIVLELKG SETTFMCEYADETATIVEFLNRWIT FCQSIISTLT (SEQ ID NO: 389) |
| DNA568 | Knob: HFc (N297A)- [VPLSLY]- hIL2 (E15F, L18C, D20R, R38A, F42A, Y45A, E62A, N88L) | APTSSSTKKT QLQLFHLCLR LQMILNGINN YKNPKLTAML TAKFAMPKKA TELKHLQCLE EALKPLEEVLN LAQSKNFHLRPR DLISLINIVLE LKGSETTFMCEY ADETATIVEFLN RWITFCQSIIST LT (SEQ ID NO: 344) | DKTHTCPPCPAPELLGGPSVFLPPPKPKDT LMISRTPEVTCVVVDVSHEDPEVKFNWYVD GVEVHNAKTKPREEQYASTYRWSVLTVLHQ DWLNGKEYCKVSNKALPAPIEKTISKAKG QPREPQVYTIPPCRDEITKNQVSLWCIVKG FYPSDIAVEWESNGQPENNYKTTPPVLDSD GSFFLYSKLTVDKSRWQQGNVFSCSVMHEA LHNHYTQKSLSLSPGGSPGVPLSLYSGPAP TSSSTKKTQLQLFHLCLRLQMILNGINNYK NPKLTAMLTAKFAMPKKATELKHLQCLEEA LKPLEEVLNLAQSKNFHIRPRDLLSLINVI VLELKGSETTFMCEYADETATIVEFLNRWI TFCQSIISTLT (SEQ ID NO: 390) |
| DNA575 | Hole: hFc (N297A, I253A)- hCD122 | | DKTHTCPPCPAPELLGGPSVFLPPPKPKDT LMASRTPEVTCVVVDVSHEDPEVKFNWYVD GVEVHNAIOKPREEQYASTYRVSVLTVLH QDWLNGKEYKCKVSNKALPAPIEKTISKAK GQPREPQVCTLPPSRDELTKNQVSLSCAVK GFYPSDIAVEWESNGQPENNYKTTPPVLDS |

-continued

| | | |
|---|---|---|
| DNA576 | Hole: hFc (N297A, M252Y, S254T, T256E)-hCD122 | DGSFFLVSKLTVDKSRWQQGNVFSCSVMHE ALHNHYTQKSLSLSPGPGSGSAVNGTSQFT CFYNSRANISCVWSQDGALQDTSCQVHAWP DRRRWNQTCELLPVSQASWACNLLIGAPDS QKLTTVDIVTLRVLCREGVRWRVMAIQPPK PFENLRIMAPISLQVVHVETHRCNISWEIS QASHYFERHLEFEARTLSPGHTWEEAPLLT LKQKQEWICLETLTPDTQYEFQVRVKPLQG EFTTVSPVVSQPLAFRTKPAALGKD (SEQ ID NO: 43) |
| DNA577 | Knob: hFc(N297, I253A)-hIL2 (R38A, F42A, Y45A, E62A, C125A) | DKTHTCPPCPAPELLGGPSVFLFPPKPKDT LYITREPEVTCVVVDVSHEDPEVKFNWYVD GVEVHNAKTKPREEQYASTYRVVSVLTVLH QDWLNGKEYKCKVSNKALPAPIEKTISKAK GQPREPQVCTLPPSRDELTKNQVSLSCAVK GFYPSDIAVEWESNGQPENNYKTTPPVLDS DGSFFLVSKLTVDKSRWQQGNVFSCSVMHE ALHNHYTQKSLSLSPGPGSGSAVNGTSQFT CFYNSRANISCVWSQDGALQDTSCQVHAWP DRRRWNQTCELLPVSQASWACNLLIGAPDS QKLTTVDIVTLRVLCREGVRWRVMAIQDFK PFENLRLMAPISLQVVHVETHRCNISWEISQ ASHYFERHLEFEARTISPGHTWEEAPLLTL KQKQEWICLETLTPDTQYEFQVRVKPLQGE FTTWSPWSQPLAFRTKPAALGKD (SEQ ID NO: 392) |
| DNA578 | Knob: hFc (N297A, M252Y, S254T, T256E)-hIL2 (R38A, F42A, Y45A, | DKTHTCPPCPAPELLGGPSVFLFPPKPKDT LMASRTPEVTCVVVDVSHEDPEVKFNWYVD GVEVHNAKTKPREEQYASTYRVVSVLTVLH QDWLNGKEYKCKVSNKAIPAPIEKTISKAK GQPREPQVYTLPPCRDELTKNQVSLWCLVK GFYPSDIAVEWESNGQPENNYKTTPPVLDS DGSFFLYSKLTVDKSRWQQGNVFSCSVMHE ALHNHYTQKSLSLSPGGGSSPPGGGSSGGG SGPAPTSSSSTKKTQLQLEHLLLDLQMILNG INNYKNPKLTAMLTAKFAMPKKATELKHLQ CLEEALKPLEEVLNIAQSKNFHLRPRDIIS NINIVLELKGSETTFMCEYADETATIVEF LNRWITFAQSIISTLT (SEQ ID NO: 393) |
| | | DKTHTCPPCPAPELLGGPSVFLFPPKPKDT LYITREPEVTCVVVDVSHEDPEVKFNWYVD GVEVHNAKTKPREEQYASTYRVVSVLTVLH QDWLNGKEYKCKVSNKALPAPIEKTISKAK GQPREPQVCTLPPCRDELTKNQVSLWCLVK GFYPSDIAVEWESNGQPENNYKTTPPVLDS DGSFFLYSKLTVDKSRWQQGNVFSCSVMHE ALHNHYTQKSLSLSPGGGSSPPGGGSSGGG SGPAPTSSSSTKKTQLQLEHLILDLQMILNG INNYKNPKLTAMLTAKFAMPKKATELKHLQ |

-continued

| | | | | |
|---|---|---|---|---|
| | E62A,<br>C125A) | | | CEEALKPLEEVLNLAQSKNFHLRPRDLISN<br>INVIVLELKGSETTFMCEYADETATIVEFL<br>NRWITFAQSIISTLT<br>(SEQ ID NO: 394) |
| DNA579 | Knob:<br>hFc(N297,<br>I253A)-<br>[VPLSLY]-<br>hIL2(R38A,<br>F42A,<br>Y45A,<br>E62A,<br>C125A) | SGP<br>(SEQ<br>ID<br>NO: 29) | APTSSSTKKTQL<br>QLEHLLLDLQMI<br>LNGINNYKNPKL<br>TAMLTAKFAMP<br>KKATELKHLQCL<br>EEALKPLEEVLN<br>LAQSKNFHLRPR<br>DLISNINVIVLEL<br>KGSETTFMCEY<br>ADETATIVEFLN<br>RWITFAQSIISTL<br>T<br>(SEQ ID<br>NO: 3) | DKTHTCPPCPAPELLGGPSVFLFPPKPKDT<br>LMASRTPEVTCVVVDVSHEDPEVKFNWYVDG<br>VEVHNAKTKPREEQYASTYRVVSVLTVLHQ<br>DWLNGKEYKCKVSNKALPAPIEKTISKAKG<br>QPREPQVYTLPPCRDELTKNQVSLWCAVKG<br>FYPSDIAVEWESNGQPE<br>NNYKTTPPVLDSDGSFFLYSKLTVDKSRWQ<br>QGNVFSCSVMHEALHNHYTQKSLSLSPGGS<br>PGVPLSLYSGPAPTSSSTKKTQLQIEHLLL<br>DLQMILNGINNYKNPKLTAMLTAKFAMPKK<br>ATELKHLQCLEEALKPLEEVLNLAQSKNFH<br>LRPRDLISNINVIVLELKGSETTFMCEYAD<br>ETATIVEFLNRWITFAQSIISTLT<br>(SEQ ID NO: 50) |
| DNA580 | Knob:<br>hFc(N297A,<br>M252Y,<br>S2547,<br>T256E)-<br>[VPLSLY]-<br>hIL2(R38A,<br>F42A,<br>Y45A,<br>E62A,<br>C125A) | SGP<br>(SEQ<br>ID<br>NO: 29) | APTSSSTKKTQL<br>QLEHLLLDLQMI<br>LNGINNYKNPKL<br>TAMLTAKFAMP<br>KKATELKHLQCL<br>EEALKPLEEVLN<br>LAQSKNFHLRPR<br>DLISNINVIVLEL<br>KGSETTFMCEY<br>ADETATIVEFLN<br>RWITFAQSIISTL<br>T<br>(SEQ ID<br>NO: 3) | DKTHTCPPCPAPELLGGPSVFLFPPKPKDT<br>LYITREPEVTCVVVDVSHEDPEVKFNWYVD<br>GVEVHNAKTKPREEQYASTYRVVSVLTVLH<br>QDWLNGKEYKCKVSNKALPAPIEKTISKAK<br>GQPREPQVYTLPPCRDELTKNQVSLWCLVK<br>GFYPSDIAVEWESNGQPENNYKTPPVLD<br>SDGSFFLYSKLTVDKSRWQQGNVF<br>SCSVMHEALHNHYTQKSLSLSPGGSPGVPL<br>SLYSGPAPTSSSTKKTQLQLEHLLLDLQMI<br>LNGINNYKNPKITAMLTAKFAMPKKATELK<br>HLQCLEEALKPLEEVLNLAQSKNFHLRPRD<br>LISNINVIVLELKGSETTFMCEYADETATI<br>VEFLNRWITFAQSIISTLT<br>(SEQ ID NO: 396) |
| DNA581 | Knob:<br>hFc(N297A)-<br>[VPLSLY]-<br>hIL2(L18C,<br>R38A, F42A,<br>Y45A, E62A) | SGP<br>(SEQ ID<br>NO: 29) | APTSSSTKKTQL<br>QLEHLCLDLQM<br>ILNGINNYKNPK<br>L7AMLTAKFAM<br>PKKATELKHLQC<br>LEEALKPLEEVL<br>NLAQSKNFHLR<br>PRDLISNINVIVL<br>ELKGSETTFMCE<br>YADETATIVEFL<br>NRWITFCQSHST<br>LT<br>(SEQ ID NO: 365) | DKTHTCPPCPAPELLGGPSVFLFPPKPKDT<br>LMISRTPEVTCVVVDVSHEDPEVKFNWYVD<br>GVEVHNAKTKPREEQYASTYRVVSVLTVLH<br>QDWLNGKEYKCKVSNKALPAPIEKTISKAK<br>GQPREPQVYTLPPCRDELTKNQVSLWCLVK<br>GFYPSDIAVEWESNGQPENNYKTTPPVLDS<br>DGSFFLY<br>SKLTVDKSRWQQGNVFSCSVMHEALKNHYT<br>QKSLSLSPGGSPGVPLSLYSGPAFTSSSTK<br>KTQLQLEHLCLDLQMILNGINNYKNPKLTA<br>MLTAKFAMPKKATELKHIQCIEEALKPLEE<br>VLNLAQSKNFHLRPRDLISNINVIVLELKG<br>SETTFMCEYADETATIVEFLNRWITFCQSI<br>ISTLT (SEQ ID NO: 397) |
| DNA582 | | SGP<br>(SEQ ID<br>NO: 29) | APTSSSTKKTQL<br>QLEYLLLDLQMI<br>LNGINNYKNPKL | DKTHTCPPCPAPELLGGPSVFLFPPKPKDT<br>LMISRTPEVTCVVVDVSHEDPEVKFNWYVD<br>GVEVHNAKTKPREEQYASTYRVVSVLTVLH |

| | | |
|---|---|---|
| | | TAMLTAKFAMP KKATELKHLQCL EEALKPLEEVIN LAQSKNFHLRPR DLISNINIVLEL KGSETTFMCEY ADETATIVEFLN RWITFAQSIISTL T (SEQ ID NO: 346) | QDWLNGKEYKCKVSNKALPAPIEKTISKAK GQPREPQVVTLPPCRDELTKNQVSLWCLVK GFYPSDIAVEWESNGQPENNYKTTPPVLDS DGSFFLY SKLTVDKSRWQQGNVFSCSVMHEALHNHYT QKSISLSPGGSPGVPLSLYSGPAPTSSSTK KTQLQLEYLLLDLQMILNGINNYKNPKLTA MLTAKFAMPKKATELKHLQCLEEALKPLEE VLNLAQSKNFHLRPRDLISNINIVLELKG SETTFMCEYADETATIVEFLNRWITFAQSH STLT (SEQ ID NO: 398) |
| DNA583 | Knob: hFc(N297A)- [VPLSLY]- hIL2(H16E, R38A, F42A, Y45A, E52A, C125A) | SGP (SEQ ID NO: 29) | APTSSSTKKTQL QLEELLLDLQMI LNGINNYKNPKL TAMLTAKFAMP KKATELKHLQCL EEALKPLEEVIN LAQSKNFHLRPR DLISNINIVLEL KGSETTFMCEY ADETATIVEFLN RWITFAQSIISTL T (SEQ ID NO: 347) | DKTHTCPPCPAPELLGGPSVFLFPPKPKDT LMISRTPEVTCVVVDVS HEDPEVKFNWYVDGVEVHNAKTKPREEQYA STYRVVSVLTVLHQDWLNGKEYKCKVSNKA LPAPIEKTISKAKGQPREPQVYTLPPCRDE LTKNQVSLW CLVKGFYPSDIAVEWESNGQPENNYIOTPP VLDSDGSFFLYSKLTVDKSRWQQGNVFSCS VMHEALHNHYTQKSLSLSPGGSPGVPLSLY SGPAPTSSSTKKTQLQLEELLLDLQMILNG INNYKNPKLTAMLTAKFAMPKKATELKHLQ CLEEALKPLEEVLNLAQSKNFHLRPRDLISN INVIVLELKGSETTFMCEYADETATIVEFL NRWITFAQSIISTLT (SEQ ID NO: 399) |
| DNA584 | Knob: hFc(N297A)- [VPLSLY]- hIL2(D20L, R38A, F42A, Y45A, E52A, C125A) | SGP (SEQ ID NO: 29) | APTSSSTKKTQL QLEHLLLLLQMI LNGINNYKNPKL TAMLTAKFAMP KKATELKHLQCL EEALKPLEEVIN LAQSKNFHLRPR DLISNINIVLEL KGSETTFMCEY ADETATIVEFLN RWITFAQSIISTL T (SEQ ID NO: 348) | DKTHTCPPCPAPELLGGPSVFLFPPKPKDT LMISRTPEVTCVVVDVSHEDPEVKENWVD GVEVHNAKTKPREEQYASTYRVVSVLTVLH QDWLNGKEYKCKVSNKALPAPIEKTISKAK GQPREPQVYTLPPCRDELTKNQVSLWCLVK GFYPSDIAVEWESNGQPENNYKTTPPVLDS DGSFFLYSKLTVDKSRWQQGNVFSCSVMHE ALHNHYTQKSLSLSPGGSPGVPLSLYSGPA PTSSSTKKTQLQLEHLLLLLQMILNGINNY KNPKLTAMLTAKFAMPKKATELKHLQCLEE ALKPLEEVLNLAQSKNFHLRPRDLISNINV IVLELKGSETTFMCEYADETATIVEFLNRW ITFAQSIISTLT (SEQ ID NO: 400) |
| DNA585 | Knob: hFc(N297A)- [VPLSLY]- hIL2(H16Y, R38A, F42A, Y45A, E52A, C125A) | SGP (SEQ ID NO: 29) | APTSSSTKKTQL QLEYLCLDLQMI LNGiNNYKNPKL TAMLTAKFAMP KKATELKHLQCL EEALKPLEEVLN LAQSKNFHLRPR DLISNINIVLEL KGSETTFMCEY ADETATIVEFLN | DKTHTCPPCPAPELLGGPSVFLFPPKPKDT LMISRTPEVTCVVVDVSHEDPEVKFNWYVD GVEVHNAKTKPREEQYASTYRVVSVLTVLH QDWLNGKEYKCKVSNKALPAPIEKTISKAK GQPREPQVVTLPPCRDELTKNQVSLWCLVK GFYPSDIAVEWESNGQPENNYKTTPPVLDS DGSFFLYSKLTVDKSRWQQGNVFSCSVMHE ALHNHYTQKSLSLSPGGSPGVPLSLYSGPA PTSSSTKKTQLQLEYLCLDLQMILNGINNY KNPKLTAMLTAKFAMPKKATELKHLQCLEE |

-continued

| | | | |
|---|---|---|---|
| DNA586 | Knob:<br>hFc(N297A)-<br>[VPLSLY]-<br>hIL2(H16E,<br>L18C, R38A,<br>F42A, Y45A,<br>E62A) | SGP<br>(SEQ ID<br>NO: 29) | RWITFCQSIISTL<br>T<br>(SEQ ID NO:<br>349) | ALKPLEEVLNLAQSKNFHLRPRDLISNINV<br>IVLELKGSETTFMCEYADETATIVEFLNRW<br>ITFCQSIISTLT (SEQ ID NO: 401) |
| DNA587 | Knob:<br>hFc(N297A)-<br>[VPLSLY]-<br>hIL2(L18C,<br>D20L, R38A,<br>F42A, Y45A,<br>E62A) | SGP<br>(SEQ ID<br>NO: 29) | APTSSSTKKTQL<br>QLEELCLDLQMI<br>LNGINNYKNPKL<br>TAMLTAKFAMP<br>KKATELKHLQCL<br>EEALKPLEEVLN<br>LAQSKNFHLRPR<br>DLISNINIVLEL<br>KGSETTFMCEY<br>ADETATIVEFLN<br>RWITFCQSIISTL<br>T<br>(SEQ ID NO:<br>350) | DKTHTCPPCPAPELLGGPSVFLFPPKPKDT<br>LMISRTPEVTCVVVDVSHEOPEV<br>KFNWYVDGVEVHNAKTKPREEQYASTYRVV<br>SVLTVLHQDVLNGKEYKCKVSNKALPAPI<br>EKTISKAKGQPREPQVYTLPPCRDELTKNQ<br>VSLWCLVKGFYPSDIAVEWESNGQPEN<br>NYKTTPPVLDSDGSFFLYSKLTVDKSRWQQ<br>GNVFSCSVMHEALHNHYTQKSLSLSPGGSP<br>GVPLSLYSGPAPTSSSTKKTQLQLEELCLD<br>LQMILNGINNYKNPKLTAMLTAKFAMPKKA<br>TELKHLQCLEEALKPLEEVLNLAQSKNFHL<br>RPRDLISNINIVLELKGSETTFMCEYADE<br>TATIVEFLNRWITFCQSIISTLT<br>(SEQ ID NO: 402) |
| DNA588 | Knob:<br>hFc(N297A)-<br>[VPLSLY]-<br>hIL2(H16Y,<br>L18C,<br>D20L, R38A,<br>F42A, Y45A,<br>E62A) | SGP<br>(SEQ ID<br>NO: 29) | APTSSSTKKTQL<br>QLEYLCLLLQMI<br>LNGINNYKNPKL<br>TAMLTAKFAMP<br>KKATELKHLQCL<br>EEALKPLEEVLN<br>LAQSKNFHLRPR<br>DLISNINIVLEL<br>KGSETTFMCEY<br>ADETATIVEFLN<br>RWITFCQSIISTL<br>T<br>(SEQ ID<br>NO: 351) | DKTHTCPPCPAPELLGGPSVFLFPPKPKDT<br>LMISRTPEVTCVVVDVSHEDPEVKFNWYVD<br>GVEVHNAICTKPREEQYASTYRVVSVLTVLH<br>QPWLNGKEYKCKVSNKALPAPIEKTISKAK<br>GQPREPQVYTLPPCRDELTKMQVSLWCLVK<br>GFYPSDIAVEWESMGQPENNYKTTPPVLDS<br>DGSFFLYSKLTVDKSRWQQGNVFSCSVMHE<br>ALHNHYTQKSLSLSPGGSPGVPLSLYSGPA<br>PTSSSTKKTQLQLEHLCLLLQMILNGINNY<br>KNPKLTAMLTAKFAMPKKATELKHLQCLEE<br>ALKPLEEVLNLAQSKNFHLRPRDLISNINV<br>IVLELKGSETTFMCBYADETATIVEFLNRW<br>ITFCQSIISTLT (SEQ ID NO: 403) |
| DNA589 | Knob:<br>hFc(N297A)-<br>[VPLSLY]-<br>hIL2(H16E, | SGP<br>(SEQ ID<br>NO: 29) | APTSSSTKKTQL<br>QLEELCLLLQMI<br>LNGINNYKNPKL<br>TAMLTAKFAMP | APTSSSTKKTQL<br>QLEELCLLLQMI<br>LNGINNYKNPKL<br>TAMLTAKFAMP | DKTHTCPPCPAPELLGGPSVFLFPPKPKDT<br>LMISRTPEVTCVVVDVSHEDPEVKFNWYVD<br>GVEVHNAKTKPREEQYASTYRVVSVLTVLHQ<br>DWLNGKEVCKVSNKALPAPIFKTISKAKG<br>(SEQ ID NO: 404) |

| | | -continued |
|---|---|---|
| | L18C, D20L, R38A, F42A, Y45A, E62A) | KKATELKHLQCL EEALKPLEEVLN LAQSKNFHLRPR DLISNINIVLEL KGSETTFMCEY ADETATIVEFLN RWITFCQSIISTL T (SEQ ID NO: 353) | QPRPPQVTLPPCRDELTKNQVSIAVCLVK GFYPSDIAVEWESNGQPENNYKTTPPVLDS DGSFFLYSKLTVDKSRWQQGNVFSCSVMHE ALHNHYTQKSLSLSPGGSPGVPLSLYSGPA PTSSSTKKTQLQLEELCLLLQMILNGINNY KNPKLT AMLTAKFAMPKKATELKHLQCLEEALKPLE EVLNLAQSKNFHLRPRDLISNINIVLELK GSETTFMCEYADETATIVEFLNRWITFCQS IISTLT (SEQ ID NO: 405) |
| DNA603 | Hole: hFcIgG4- hCD122 | | ESKYGPPCPPCPAPEFLGGPSVFLFPPKPK DTLMISRTPEVTCVVVDVSQEDPEVQFNWY VDGVEVHNAKTKPREEQFNSTYRVVSVLTV LHQDWLNGKEYKCKVSNKGLPSSIEKTISK AKGQPREPQVYTLPPSQEEMTKNQVSLSCA VKGFYPSDIAVEWESNGQPENNYKTTPPVL DSDGSFFLYSRLTVDKSRWQEGNVFSCSVM HEALHNHYTQKSLSLSL GPGSGSAVNGTSQFTCFYNSRANISCVWSQ DGALQDTSCQVHAWPDRRRWNQTCELLPVS QASWACNLILGAPDSQKLTTVDIVTLRVLC REGVRWRVMAIQDFKPFENLRLNAPISLQW HVETHRCNISW EISQASHYFERHLEFEARTLSPGHTWEEAP LLTLKQKQEWICLETLTPDTQYEFQVRVKP LQGEFTTWSPWSQPLAFRTKPAALGKD (SEQ ID NO: 406) |
| DNA604 | Knob: IgG4 hFc- hIL2(R38A, F42A, Y45A, E62A, C125A) | | ESKYGPPCPPCPAPEFLGGPSVFLFPPKPK DTLMISRTPEVTCVVVDVSQEDPEVQFNWY VDGVEVHNAKTKPREEQFNSTYRVVSVLTV LHQDWLNGKEYKCKVSNKGLPSSIEKTISK AKGQPREPQVYTLPPCQEEMTKNQVSLWCL VKGFYPSDIAVEWESNGQPENNYKTTPPVL DSDGSFFLYSRLTVDKSRWQEGNVFSCSVM HEALHNHYTQKSLSLSLGGGSSPPGGGSSG GGSGPAPTSSSTKKTQLQLEHLLLDLQMIL NGINNYKNPKLTAMLTAKFAMPKKATELKH LQCLEEALKPLEEVLNLAQSKNFHLRPRDL ISNINIVLELKGSETTFMCEYADETATIV EFLNRWITFAQSIISTLT (SEQ ID NO: 407) |
| DNA605 | Knob: hFcIgG4-hIL2- [VPLSLY]- hIL2(R38A, F42A, Y45A, E62A, C125A) | APTSSSTKKTQL QLEHLLLDLQMI LNGINNYKNPKL TAMLTAKFAMP KKATELKHLQCL EEALKPLEEVLN LAQSKNFHLRPR DLISNINIVL ELKGSETTFMC SGP (SEQ ID NO: 29) | ESKYGPPCPPCPAPEFLGGPSVFLFPPKPK DTLMISRTPEVTCVVVDVSQEDPEVQFNWY VDGVEVHNAKTKPREEQFNSTYRVVSVLTV LHQDWLNGKEYKCKVSNKGLPSSIEKTISK AKGQPREPQVYTLPPCQEEMTKNQVSLWCL VKGFYPSDIAVEWESMGQPENNYKTTPPVL DSDGSFFLYSRLTVDKSRWQEGNVFSCSVM HEALHNHYTQKSLSLSLGGSPGVPLSLYSG PAPTSSSTKKTQLQLEHLLLDLQMILNGIN |

-continued

| | | | |
|---|---|---|---|
| DNA606 | Hole: hFc(N297A)-[RAAAVKSP]-hCD122 | AVNGTSQFTCF YNSRANISCVW SQDGALQDTSC QVHAWPDRRR WNQTCELLPVS QASWACNLILG APDSQKLTTVDI VTLRVLCREGVR MRVMAIQDFK PFENLRLMAPIS LQVVHETHRC NISWEISQASHY FERHLEFEARTL SPGHTWEEAPL LTLKQKQEWICL ETLTPDTQYEFQ VRVKPLQGEFTT WSPWSQPLAFR TKPAALGKD (SEQ ID NO: 4) SGGG (SEQ ID NO: 30) | EYADETATIVEF LNRWITFAQSII STLT (SEQ ID NO: 3) NYKNPKLTAMLTAKFAMPKKATELKHLQCL EEALKPLEEVLNLAQSKNFHLRPPDLISNI NVIVLELKGSETTFMCEYAOETATIVEFLN RWITFAQSIISTLT (SEQ ID NO: 408) DKTHTCPPCPAPELLGGPSVFLFPPKPKDTL MISRTPEVTCVVVDVSHEDPEVKFNWYVDG VEVHNAKTKPREEQYASTYRVVSVLTVLHQ DWLNGKEYKCKVSNKALPAPIEKTISKAKG QPREPQVCTLPPSRDELTKNQVSLSCAVKG FYPSDIAVEWESMGQPENNYKTTPPVLDSD GSFFLVSKLTVDKSRWQQGNVFSCSVMHEA LHNHYTQKSLSLPGGPPSGSSPRAAAVKS PSGGGAVNGTSQFTCFYNSRANISCVLVSQ OGALQDTSCQVHAWPDRRRMNQTCELLPVS QASWACNLILGAPDSQKLTTVDIVTLRVLC REGVRWRVMAIQDFKPFENLRLMAPISLQV VHVETHRCNISWEISQASHYFERHLEFEAR TLSPGHTWEEAPLLTLKQKQEWICLETLTP DTQYEFQVRVKPLQGEFITTWSPWSQPLAFR TKPAALGKD (SEQ ID NO: 409) |
| DNA608 | Hole: hFc(N297A, I253A)-[MPYDLYHP]-hCD122 | AVNGTSQFTCF YNSRANISCVW SQDGALQDTSC QVHAWPDRRR WNQTCELLPVS QASWACNLILG APDSQKLTTVDI VTLRVLCREGVR MRVMAIQDFK PFENLRLMAPIS LQVVHETHRC NISWEISQASHY FERHLEFEARTL SPGHTWEEAPL LTLKQKQEWICL ETLTPDTQYEFQ VRVKPLQGEFTT WSPWSQPLAFR TKPAALGKD (SEQ ID NO: 4) SGGG (SEQ ID NO: 30) | DKTHTCPPCPAPELLGGPSVFLFPPKPKDTL MASRTPEVTCVVVDVSHEDPEVKFNWYVDG VEVHNAKTKPREEQYASTYRVVSVLTVLHQ DWLNGKEYKCKVSNKALPAPIEKTISKAKG QPREPQVCTLPPSRDELTKNQVSLSCAVKG FYPSDIAVEWESNGQPENNYKTTPPVLDSD GSFFLVSKLTVDKSRWQQGNVFSCSVMHEA LHNHYTQKSLSLPGGPPSGSSPMPYDLYH PSGGGAVNGTSQFTCFYNSRANISCVWSQD GALQDTSCQVHAWPDRRRWNQTCELLPVSQ ASWACNLILGAPDSQKLTTVDIVTLRVLCRE GVRWRVMAIQDFKPFENLRLMAPISLQVVH VETHRCNISWEISQASHYFERHLEFEARTL SPGHTWEEAPLLTLKQKQEWICLETLTPDT QYEFQVRVKPLQGEFTTWSPWSQPLAFRTK PAALGKD (SEQ ID NO: 410) |
| DNA609 | Hole: hFc(N297A, I253A)-[VPLSLY]-hCD122 | AVNGTSQFTCF YNSRANISCVW SQDGALQDTSC QVHAWPDRRR WNQTCELLPVS GSGGG (SEQ ID NO: 31) | DKTHTCPPCPAPELLGGPSVFLFPPKPKDTL MASRTPEVTCVVVDVSHEDPEVKFNWYVDG EVHNAKTKPREEQYASTYRVVSVLTVLHQD WLNGKEYKCKVSNKALPAPIEKTISKAKGQ PREPQVCTLPPSRDELTKNQVSLSCAVKGF |

|  |  |  |
|---|---|---|
|  | QASWACNLILG<br>APDSQKLTTVDI<br>VTLRVLCREGVR<br>WRVMAIQDFK<br>PFENLRLMAPIS<br>LQVVHVETHRC<br>NISWEISQASHY<br>FERHLEFEARTL<br>SPGHTWEEAPL<br>LTLKQKQEWICL<br>ETLTPDTQYEFQ<br>VRVKPLQGEFTT<br>WSPWSQPLAFR<br>TKPAALGKD<br>(SEQ ID NO: 4) | YPSDIAVEVVESNGQPENNYKTPPVLDSD<br>GSFFLVSKLITVDKSRWQQGNVFSCSVMHEAL<br>HNHYTQKSLSLPGGPPSGSSPGVPLSLYG<br>SGGGAVNGTSQFTCFYNSRANISCVWSQDG<br>ALQDTSCQVHAWPDRRWNQTC<br>ELLPVSQASWACNLILGAPDSQKLTTVDIV<br>TLRVLCREGVRWRVMAIQDFKPFENLRLMA<br>PISLQVVHVETHRCNISWEISQASHYFERH<br>LEFEARTLSPGHTWEEAPLLTLKQKQEWIC<br>LETLTPDTQYEFQVRVKPLQGEFTTWSPWS<br>QPLAFRTKPAALGKD<br>(SEQ ID NO: 411) |
| DNA614 | Hole:<br>hFc(N297A)-<br>[MPYDLYHP]-<br>hCD122<br>(C122S,<br>C168S) | SGGG<br>(SEQ ID<br>NO: 30) | AVNGTSQFTCF<br>YNSRANISCVW<br>SQDGALQDTSC<br>QVHAWPDRRR<br>WNQTCELLPVS<br>QASWACNLILG<br>APDSQKLTTVDI<br>VTLRVLCREGVR<br>WRVMAIQDRC<br>PFENLRLMAPIS<br>LQWHVETHRS<br>NISWEISQASHY<br>FERHLEFEARTL<br>SPGHTWEEAPL<br>LTLKQKQEWISL<br>ETLTPDTQYEFQ<br>VRVKPLQGEFTT<br>WSPWSQPLAFR<br>TKPAALGKD<br>(SEQ ID NO: 5) | DKTHTCPPCPAPELLGGPSVFLFPPKPKDTL<br>MISRTPEVTCVVVDVSHEDPEVKFNWYVDG<br>VEVHNAKTKPREEQYASTYRVVSVLTVLHQ<br>DWLNGKEYKCKVSNKALPAPIEKTISKAKG<br>QPREPQVCTLPPSRDELTKNQVSLSCAVKG<br>FYPSQIAVEWESNGQPENNYKTPPVLDSD<br>GSFFLVSKLTVDKSRWQQGNVFSCSVMHEA<br>LHNHYTQKSLSLPGGPPSGSSPMPYDLYH<br>PSGGGAVNGTSQFTCFYNSRANISCVWSQD<br>GALQDTSCQVHAWPDRRWNQTCELLPVSQ<br>ASWACIMLJILGAPDSQKLTTVDIVTLRVLC<br>REGVRWRVMAIQDFKPFENLRLMAPISLQV<br>VHVETHRSNISWEISQASHYFERHLEFEAR<br>TISPGHTWEEAPLLTIKQKQEWISLETLTP<br>DTQYEFQVRVKPLQGEFTTWSPWSQPLAFR<br>TKPAALGKD (SEQ ID NO: 40) |
| ANA614 | Hole:<br>hFc(N297A)-<br>[DSGGMLT]-<br>hCD122<br>(C122S,<br>C168S) | SGGG<br>(SEQ ID<br>NO: 30) | AVNGTSQFTCF<br>YNSRANISCVW<br>SQDGALQDTSC<br>QVHAWPDRRR<br>WNQTCELLPVS<br>QASWACNLILG<br>APDSQKLTTVDI<br>VTLRVLCREGVR<br>WRVMAIQDRC<br>PFENLRLMAPIS<br>LQWHVETHRS | DKTHTCPPCPAPELLGGPSVFLFPPKPKDT<br>LMISRTPEVTCVVVDVSHEDPEVKFNWYVD<br>GVEVHNAKTKPREEQYASTYRVVSVLTVLH<br>QDWLNGKEYKCKVSNKALPAPIEKTISKAK<br>GQPREPQVCTLPPSRDELTKNQVSLSCAVK<br>GFYPSQIAVEWESNGQPENNYKTPPVLDS<br>DGSFFLVSKLTVDKSRWQQGNVFSCSVMHE<br>ALHNHYTQKSLSLPGGPPSGSSPGDSGGF<br>MLTSGGGAVNGTSGFTCFYNSRANISCVWS<br>QDGALQDTSCQVHAWPDRRWNQTCELLPV<br>SQASWACNLILGAPDSQKLTTVDIVTLRVL |

-continued

| | | |
|---|---|---|
| | | NISWEISQASHY FERHLEFEARTL SPGHTWEEAPL LTLKQKQEWISL ETLTPDTQYEFQ VRVKPLQGEFTT WSPWSQPLAFR TKPAALGKD (SEQ ID NO: 5) | CREGVRWRVMAIQDFKPFENLRLMAPISLQ VVHVETHRSNISWEISQASHYFERHLEFEA RTLSPGHTWEEAPLLTLKQKQEWISLETIT PDTQYEFQVRVKPLQGEFTTWSPWSQPLAF RTKPAALGKD (SEQ ID NO: 413) |
| DNA623 | Knob: hFc(N297, I253A)- [MPYDLYHP] hIL2 (R38A, F42A, Y45A, E62A, C125A) SGP (SEQ ID NO: 29) | APTSSSTKKTQL QLEHLLLDLQMI LNGINNYKNPKL TAMLTAKFAMP KKATELKHLQCL EEALKPLEEVLN LAQSKNFHLRPR DLISNINIVL ELKGSETTFMC EYADETATIVEF LNRWITFAQSII STLT (SEQ ID NO: 3) | DKTHTCPPCPAPELLGGPSVFLFPPKPKDTL MASRTPEVTCVVVDVSHEDPEVKFNWYVDG VEVHNAKTKPREEQYASTYRVVSVLTVLHQ PWLNGKEYKCKVSNKALPAPIEKTISKAKG QPREEQVYTLPPCRDELTKNQVSLWCLVKG FYPSDIAVEWESNGQPENNYKTTPPVLDSD GSFFLYSKLTVDKSRWQQGNVFSCSVMHEA LHNHYTQKSLSLSPGGGSSPPMPYDLYHPS GPAPTSSSTKKTQLQLEHLLLDLQMILNGI NNYKNPKLTAMLTAKFAMPKKATELKHLQC LEEALXPLEEVLNLAQSKNFHLRPPRDLISN INVIVLELKGSETTFMCEYADETATIVEFL NRWITFAQSIISTLT (SEQ ID NO: 415) |
| DNA625 | Hole: hFc(N297, I253A) | | DKTHTCPPCPAPELLGGPSVFLPPP KPKDTLMASRTPEVTCVVVDVSHEQ PEVKFNWYVDGVEVHNAKTKPREEQ YASTYRVVSVLTVLHQDWLNGKEYK CKVSNKALPAPIEKTISKAKGQPRE PQVCTLPPSRDELTKNQVSLSCAVK GFYPSDIAVEWESNGQPENNYKTTP PVLDSDGSFFIVSKLTVDKSRWQQG NVFSCSVMHEALHNHYTQKSLSLSP G (SEQ ID NO: 10) |
| DNA626 | Hole: hFcIGg4 | | ESKYGPPCPPCPAPEFLGGPSVFLPPKPK DTLMISRTPEVTCVVVDVSQEDPEVQFNWY VDGVEVHNAKTKPREEQFNSTYRVVSVLTV LHQDWLNGKEYKCKVSNKGLPSSIEKTISK AKGQPREPQVCTLPPSQEEMTKNQVSLSCA VKGFYPSDIAVEWESNGQPENNYKTTPPVL DSDGSFFLYSRLTVDKSRWQEGNVFSCSVM HEALHNHYTQKSLSLGPG (SEQ ID NO: 298) |

-continued

| | | |
|---|---|---|
| DNA669 | Hole: hFc-hCD122 | DKTHTCPPCPAPELLGGPSVFLFPPKPKDT LMISRTPEVTCVVVDVSHEDPEVKFNWYVD GVEVHNAKTKPREEQYNSTYRVVSVLTVLH QDWINGKEYKCKVSNKALPAPIEKTISKAK GQPREPQVCTLPPSRDELTKNQVSLSCAVK GFYPSDIAVEWESNGQPENNYKTTPPVLDS DGSFFLVSKLTVDKSRWQQGNVFSCSVMHE ALHMHYTQKSLSLSPGSGSAVNGTSQFT CFYNSRANISCVWSQDGALQDTSCQVHAWP DRRRWNQTCELLPVSQASWACNLILGAPDS QKLTTVDIVTLRVLCREGVRWRVMAIQDFK PFENLRLMAPISLQWHVETHRCNISWEISQ ASHYFERHLEFEARTLSPGHTWEEAPLLTL KQKQEWICLETLTPDTQYEFQVRVKPLQGE FTTWSPWSQPLAFRTKPAALGKD (SEQ ID NO: 422) |
| DNA670 | Knob: hFc-hIL2 (R38A, F42A, Y45A, E62A, C125A) | DKTHTCPPCPAPELLGGPSVFLFPPKPKDT LMISRTPEVTCVVVDVSHEDPEVKFNWYVDG VEVHNAKTKPREEQYNSTYRVVSVLTVLHQD WLNGKEYKCKVSNKALPAPIEKTISKAKGQ PREPQWTLPPCRDELTKNQVSLWCLVKGFY PSDIAVEWESNGQPENNYKTTPPVLDSDGS FFLYSKLTVDKSRWQQGNVFSCSVMHEALH NHYTQKSLSLSPGGGSSPPGGGSSGGGSGP APTSSSTKKTQLQLEHLLLDLQMILNGINNI YKNPKLTAMLTAKFAMPKKATELKHLQCLE EALKPLEEVLNLAQSKNFHLRPRDLISNIN VIVLELKGSETTFMCEYADETATIVEFLNR WITFAQSIISTLT (SEQ ID NO: 423) |
| DNA671 | Knob: hFc-[VPLSLY]-hIL2 (R38A, F42A, Y45A, E62A, C125A) | DKTHTCPPCPAPELLGGPSVFLFPPKPKDT IMISRTPEVTCVVVDVSHEDPEVKFNWYV DGVEVHNAKTKPREEQYNSTYRVVSV LTVLHQDWLNGKEYKCKVSNKALPAPIEKT ISKAKGQPREPQVYTLPPCRDELTKNQVSL WCLVKGFYPSDIAVEWESNGQPENNYKTTP PVLCSDGSFFLYSKLTVDKSRWQQGNVFSC SVMHEALHNHYTQKSLSLSPGSSPGVPLSL YSGPAPTSSSTKKTQLQLEHLLLDLQMILN GINNYKNPKLTAMLTAKFAMPKKATELKHL QCIEEALKPLEEVLNLAQSKNFHIRPRDLI SNINIVLELKGSETTFMCEYADETATIVE FLNRWITFAQSRSTLT (SEQ ID NO: 424) |
| | SGP (SEQ ID NO: 29) | APTSSSTKKTQL QLEHLLLDLQMI LNGINNYKNPKL TAMLTAKFAMP KKATELKHLQCL EEALKPLEEVLN LAQSKNFHLRPR DLISNINIVLEL KGSETTFMCEY ADETATIVEFLN RWITFAQSIISTL T (SEQ ID NO: 3) |

| | | |
|---|---|---|
| DNA672 | Hole: hFc-[VPLSLY]-hCD122 | GSGGG (SEQ ID NO: 31) | AVNGTSQFTCF YNSRANISCVW SQDGALQDTSC QVHAWPDRRR WNQTCELLPVS QASWACNLILG APDSQKLTTVDI VTLRVLCREGVR WRVMAIQDFK PFENLRLMAPIS LQVVHVETHRC NISWEISQASHY FERHLEFEARTL SPGHTWEEAPL LTLKQEWICL ETLTPDTQYEFQ VRVKPLQGEFTT WSPWSQPLAFR TKPAALGKD (SEQ ID NO: 4) | DKTHTCPPCPAPELLGGPSVFIFPPKPKDTL MISRTPEVTCVVVDVSHEDPEVKFNWYVDG VEVHNAKTKPREEQYNSTYRVVSVLTVLHQ DWLNGKEYKCKVSNKALPAPIEKTISKAKG QPREPQVCTLPPSRDELTKNQVSLSCAVKG FYPSDIAVEWESNGQPENNYKTTPPVLDSD GSFFLVSKLTVDKSRWQQGNVFSCSVMHEA LHNHYTQKSLSLSPGGPSGSSPGVPLSLY GSGGGAVNGTSQFTCFYNSRANISCVWSQD GALQDTSCQVHAWPDRRRWNQTCELLPVSQ ASWACNLILGAPDSQKLTTVDIVTIRVLCR EGVRWRVMAIQDFKPFENLRLMAPISLQVV HVETHRCNISWEISQASHYFERHLEFEART LSPGHTWEEAPLITIKQKQEWSCIETITPD TQYEFQVRVKPLQGEFTTWSPWSQPLAFRT KPAALGKD (SEQ ID NO: 425) |

SEQUENCE LISTING (445 sequences)

SEQ ID NO: 1 - protein, 153 aa, Artificial Sequence
  Description of Artificial Sequence: Synthetic polypeptide
  Cytokine
MYRMQLLSCIALSLALVTNSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 2 - protein, 133 aa, Artificial Sequence [sequence omitted]

SEQ ID NO: 3 - protein, 133 aa, Artificial Sequence
  Description of Artificial Sequence: Synthetic polypeptide
  Cytokine
APTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 4 - protein, 213 aa, Artificial Sequence
  Description of Artificial Sequence: Synthetic polypeptide
  Masking moiety
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 5 - protein, 213 aa, Artificial Sequence
  Description of Artificial Sequence: Synthetic polypeptide
  Masking moiety
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRSNISWEISQASHYFERHLEFEARTLSPGHTWEEAPLLTLKQKQEWISLETLTPDTQYEFQVRVKPLQGEFTTWSPWSQPLAFRTKPAALGKD

SEQ ID NO: 6 - protein, 330 aa, Artificial Sequence [sequence omitted]

SEQ ID NO: 7 - protein, 226 aa, Artificial Sequence
  Description of Artificial Sequence: Synthetic polypeptide
  Fc
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 8 - protein, 226 aa, Artificial Sequence
  Description of Artificial Sequence: Synthetic polypeptide
  Fc
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 9 - protein, 226 aa, Artificial Sequence
  Description of Artificial Sequence: Synthetic polypeptide
  Fc
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 10 - protein, 226 aa, Artificial Sequence
  Description of Artificial Sequence: Synthetic polypeptide
  Fc
DKTHTCPPCPAPELLGGPSVFLFPPKPKDTLMASRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 11 - protein, 226 aa, Artificial Sequence
  Description of Artificial Sequence: Synthetic polypeptide
  Fc
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 12 - protein, 226 aa, Artificial Sequence
  Description of Artificial Sequence: Synthetic polypeptide
  Fc
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 13 - protein, 226 aa, Artificial Sequence
  Description of Artificial Sequence: Synthetic polypeptide
  Fc
DKTHTCPPCPAPELLGGPSVFLFPPKPKDTLMASRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 14 - protein, 5 aa, Artificial Sequence
  Description of Artificial Sequence: Synthetic peptide
  Linker
PGSGS

SEQ ID NO: 15 - protein, 21 aa, Artificial Sequence
  Description of Artificial Sequence: Synthetic peptide
  Linker
GPPSGSSPGDSGGFMLTSGGG

SEQ ID NO: 16 - protein, 20 aa, Artificial Sequence
  Description of Artificial Sequence: Synthetic peptide
  Liner
GPPSGSSPGVPLSLYGSGGG

SEQ ID NO: 17 - protein, 20 aa, Artificial Sequence
  Description of Artificial Sequence: Synthetic peptide
  Linker
GPPSGSSPMPYDLYHPSGGG

SEQ ID NO: 18 - protein, 17 aa, Artificial Sequence
  Description of Artificial Sequence: Synthetic peptide
  Linker
GGSSPPMPYDLYHPSGP

SEQ ID NO: 19 - protein, 13 aa, Artificial Sequence
  Description of Artificial Sequence: Synthetic peptide
  Linker
GSPGVPLSLYSGP

SEQ ID NO: 20 - protein, 15 aa, Artificial Sequence
  Description of Artificial Sequence: Synthetic peptide
  Linker
GGSGRAAAVKSPSGP

SEQ ID NO: 21 - protein, 13 aa, Artificial Sequence
  Description of Artificial Sequence: Synthetic peptide
  Linker
GGSGHEQLTVSGP

SEQ ID NO: 22 - protein, 15 aa, Artificial Sequence
  Description of Artificial Sequence: Synthetic peptide
  Linker
GSGPDSGGFMLTSGP

SEQ ID NO: 23 - protein, 17 aa, Artificial Sequence
  Description of Artificial Sequence: Synthetic peptide
  Linker
GGSSPPGGGSSGGGSGP

SEQ ID NO: 24 - protein, 8 aa, Artificial Sequence
  Description of Artificial Sequence: Synthetic peptide
  Cleavable peptide
MPYDLYHP

SEQ ID NO: 25 - protein, 8 aa, Artificial Sequence
  Description of Artificial Sequence: Synthetic peptide
  Cleavable peptide
DSGGFMLT

SEQ ID NO: 26 - protein, 6 aa, Artificial Sequence
  Description of Artificial Sequence: Synthetic peptide
  Cleavable peptide
HEQLTV

SEQ ID NO: 27 - protein, 8 aa, Artificial Sequence
  Description of Artificial Sequence: Synthetic peptide
  Cleavable peptide
RAAAVKSP

SEQ ID NO: 28 - protein, 6 aa, Artificial Sequence
  Description of Artificial Sequence: Synthetic peptide
  Cleavable peptide
VPLSLY

SEQ ID NO: 29 - protein, 3 aa, Artificial Sequence
  Description of Artificial Sequence: Synthetic peptide
SGP

SEQ ID NO: 30 - protein, 4 aa, Artificial Sequence
  Description of Artificial Sequence: Synthetic peptide
  Linker
SGGG

SEQ ID NO: 31 - protein, 5 aa, Artificial Sequence
  Description of Artificial Sequence: Synthetic peptide
  Linker
GSGGG

SEQ ID NO: 32 - protein, 6 aa, Artificial Sequence
  Description of Artificial Sequence: Synthetic peptide
  Linker
GGSSPP

SEQ ID NO: 33 - protein, 4 aa, Artificial Sequence
  Description of Artificial Sequence: Synthetic peptide
  Linker
GSGP

SEQ ID NO: 34 - protein, 4 aa, Artificial Sequence
  Description of Artificial Sequence: Synthetic peptide
  Linker
GSPG

SEQ ID NO: 35 - protein, 4 aa, Artificial Sequence
  Description of Artificial Sequence: Synthetic peptide
  Linker
GGSG

SEQ ID NO: 36 - protein, 9 aa, Artificial Sequence
  Description of Artificial Sequence: Synthetic peptide
  Linker
GPPSGSSPG

SEQ ID NO: 37 - protein, 8 aa, Artificial Sequence
  Description of Artificial Sequence: Synthetic peptide
  Linker
GPPSGSSP

SEQ ID NO: 38 - protein, 444 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGPGSGSAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 39 - protein, 444 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGPGSGSAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRSNISWEISQASHYFERHLEFEARTLSPGHTWEEAPLLTLKQKQEWISLETLTPDTQYEFQVRVKPLQGEFTTWSPWSQPLAFRTKPAALGKD

SEQ ID NO: 40 - protein, 459 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGPPSGSSPMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRSNISWEISQASHYFERHLEFEARTLSPGHTWEEAPLLTLKQKQEWISLETLTPDTQYEFQVRVKPLQGEFTTWSPWSQPLAFRTKPAALGKD

SEQ ID NO: 41 - protein, 460 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGPPSGSSPGDSGGFMLTSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 42 - protein, 459 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGPPSGSSPGVPLSLYGSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 43 - protein, 444 aa, Artificial Sequence
  Description of Artificial Sequence: Synthetic polypeptide
  Polypeptide chain
DKTHTCPPCPAPELLGGPSVFLFPPKPKDTLMASRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGPGSGSAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 44 - protein, 459 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGPPSGSSPMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 45 - protein, 376 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 46 - protein, 374 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSGRAAAVKSPSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 47 - protein, 372 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSGHEQLTVSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 48 - protein, 374 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSGPDSGGFMLTSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 49 - protein, 372 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 50 - protein, 372 aa, Artificial Sequence
  Description of Artificial Sequence: Synthetic polypeptide
  Polypeptide chain
DKTHTCPPCPAPELLGGPSVFLFPPKPKDTLMASRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 51 - protein, 376 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPGGGSSGGGSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 52 - protein, 140 aa, Artificial Sequence
  Description of Artificial Sequence: Synthetic polypeptide
  Cleavage product
LYHPSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 53 - protein, 140 aa, Artificial Sequence
  Description of Artificial Sequence: Synthetic polypeptide
  Cleavage product
VKSPSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 54 - protein, 139 aa, Artificial Sequence
  Description of Artificial Sequence: Synthetic polypeptide
  Cleavage product
LTVSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 55 - protein, 140 aa, Artificial Sequence
  Description of Artificial Sequence: Synthetic polypeptide
  Cleavage product
FMLTSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 56 - protein, 138 aa, Artificial Sequence
  Description of Artificial Sequence: Synthetic polypeptide
  Cleavage product
LYSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 57 - protein, 615 aa, Artificial Sequence
  Description of Artificial Sequence: Synthetic polypeptide
  Cleavage product
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPGGGSSGGGSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLTDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGPPSGSSPGDSGG

SEQ ID NO: 58 - protein, 615 aa, Artificial Sequence
  Description of Artificial Sequence: Synthetic polypeptide
  Cleavage product
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPGGGSSGGGSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLTDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGPPSGSSPGVPLS

SEQ ID NO: 59 - protein, 614 aa, Artificial Sequence
  Description of Artificial Sequence: Synthetic polypeptide
  Cleavage product
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPGGGSSGGGSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLTDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGPPSGSSPMPYD

SEQ ID NO: 60 - protein, 164 aa, Artificial Sequence
  Description of Artificial Sequence: Synthetic polypeptide
  Masking moiety
ELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICT

SEQ ID NO: 61 - protein, 2 aa, Artificial Sequence
  Description of Artificial Sequence: Synthetic peptide
PA

SEQ ID NO: 62 - protein, 133 aa, Artificial Sequence
  Description of Artificial Sequence: Synthetic polypeptide
  Cytokine
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 63 - protein, 35 aa, Artificial Sequence
  Description of Artificial Sequence: Synthetic polypeptide
  Linker
GGGGGGGGGGGGGGGGGGGGGGGGGGGGGGGGGGG

SEQ ID NO: 64 - protein, 188 aa, Artificial Sequence
  Description of Artificial Sequence: Synthetic polypeptide
  Masking moiety
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 65 - protein, 226 aa, Artificial Sequence
  Description of Artificial Sequence: Synthetic polypeptide
  Fc
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 66 - protein, 767 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGPAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGGGGGGGGGGGGGGGGGGGGGGGGGGGGGGGGGGGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTGPPSGSSPMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQWHVETHRCNISWEISQASHYFERHLEFEARTLSPGHTWEEAPLLTLKQKQEWICLETLTPDTQYEFQVRVKPLQ

SEQ ID NO: 67 - protein, 359 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 68 - protein, 359 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 69 - protein, 133 aa, Artificial Sequence
  Description of Artificial Sequence: Synthetic polypeptide
  Cytokine
APTSSSTKKTQLQLEHLLLDLQMILNGINNYKNPKLTRMLTFKFYMPKKATELKHLQCLEERLKPLEEVLNLAQSKNFHLRPRDLISNINVIVLELKGSETTFMCEYADETATIVEFLNRWITFAQSIISTLT

SEQ ID NO: 70 - protein, 133 aa, Artificial Sequence
  Description of Artificial Sequence: Synthetic polypeptide
  Cytokine
APTSSSTKKTQLQLEHLLLDLQMILNGINNYKNPKLTRMLTEKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 71 - protein, 133 aa, Artificial Sequence
  Description of Artificial Sequence: Synthetic polypeptide
  Cytokine
APTSSSTKKTQLQLEHLLLDLQMILNGINNYKNPKLTRMLTFKFYMPKKATELKHLQCLEFSLKPLFFVLNLAQSKNFHLRPRDLISNINVIVLFLKGSETTFMCFYADFTATIVFFLNRWITFAQSIISTLT

SEQ ID NO: 72 - protein, 133 aa, Artificial Sequence
  Description of Artificial Sequence: Synthetic polypeptide
  Cytokine
APTSSSTKKTQLQLEHLLLDLQMILNGINNYKNPKLTRMLTAKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 73 - protein, 133 aa, Artificial Sequence
  Description of Artificial Sequence: Synthetic polypeptide
  Cytokine
APTSSSTKKTQLQLEHLLLDLQMILNGINNYKNPKLTRMLTFKFRMPKKATELKHLQCLEEELKPLEEVLNLAQSKNFHLRPRDLISNINVIVLELKGSETTFMCEYADETATIVEFLNRWITFAQSIISTLT

SEQ ID NO: 74 - protein, 133 aa, Artificial Sequence
  Description of Artificial Sequence: Synthetic polypeptide
  Cytokine
APTSSSTKKTQLQLEHLLLDLQMILNGINNYKNPKLTRMLTSKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 75 - protein, 4 aa, Artificial Sequence
  Description of Artificial Sequence: Synthetic peptide
  Linker
PGSG

SEQ ID NO: 76 - protein, 17 aa, Artificial Sequence
  Description of Artificial Sequence: Synthetic peptide
  Linker
GGSSPPRAAAVKSPSGP

SEQ ID NO: 77 - protein, 17 aa, Artificial Sequence
  Description of Artificial Sequence: Synthetic peptide
  Linker
GGPGGPRAAAVKSPSGP

SEQ ID NO: 78 - protein, 13 aa, Artificial Sequence
  Description of Artificial Sequence: Synthetic peptide
  Linker
GSPGVPLSLYSGP

SEQ ID NO: 79 - protein, 227 aa, Artificial Sequence
  Description of Artificial Sequence: Synthetic polypeptide
  Fc
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 80 - protein, 226 aa, Artificial Sequence
  Description of Artificial Sequence: Synthetic polypeptide
  Fc
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRKELTKNQVSLWCLVKGFYPSDIAVEWESNGQPENNYKTTPPVLKSDGSFFLYSKLTVDKSRWQQGNVFSCSVMHEALHNHYTQKSLSLSPG

SEQ ID NO: 81 - protein, 226 aa, Artificial Sequence
  Description of Artificial Sequence: Synthetic polypeptide
  Fc
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYDTTPPVLDSDGSFFLVSDLTVDKSRWQQGNVFSCSVMHEALHNHYTQKSLSLSPG

SEQ ID NO: 82 - protein, 226 aa, Artificial Sequence
  Description of Artificial Sequence: Synthetic polypeptide
  Fc
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRKKLTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 83 - protein, 226 aa, Artificial Sequence
  Description of Artificial Sequence: Synthetic polypeptide
  Fc
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVEGFYPSDIAVEWESNGQPENNYKTTPPVLDSDGSFFLVSKLTVDKSRWQQGNVFSCSVMHEALHNHYTQESLSLSPG

SEQ ID NO: 84 - protein, 227 aa, Artificial Sequence
  Description of Artificial Sequence: Synthetic polypeptide
  Fc
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRKKLTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 85 - protein, 376 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 86 - protein, 459 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRKELTKNQVSLWCLVKGFYPSDIAVEWESNGQPENNYKTTPPVLKSDGSFFLYSKLTVDKSRWQQGNVFSCSVMHEALHNHYTQKSLSLSPGGPPSGSSPMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 87 - protein, 359 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYDTTPPVLDSDGSFFLVSDLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 88 - protein, 459 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRKKLTKNQVSLWCLVKGFYPSDIAVEWESNGQPENNYKTTPPVLDSDGSFFLYSKLTVDKSRWQQGNVFSCSVMHEALHNHYTQKSLSLSPGGPPSGSSPMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 89 - protein, 359 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVEGFYPSDIAVEWESNGQPENNYKTTPPVLDSDGSFFLVSKLTVDKSRWQQGNVFSCSVMHEALHNHYTQESLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 90 - protein, 376 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVEGFYPSDIAVEWESNGQPENNYKTTPPVLDSDGSFFLVSKLTVDKSRWQQGNVFSCSVMHEALHNHYTQESLSLSPGGGSSPPMPYDLYHPSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 91 - protein, 227 aa, Artificial Sequence; identical to SEQ ID NO: 84
  Description of Artificial Sequence: Synthetic polypeptide
  Polypeptide chain

SEQ ID NO: 92 - protein, 442 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRKKLTKNQVSLWCLVKGFYPSDIAVEWESNGQPENNYKTTPPVLDSDGSFFLYSKLTVDKSRWQQGNVFSCSVMHEALHNHYTQKSLSLSPGPGSGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQWHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 93 - protein, 376 aa, Artificial Sequence; identical to SEQ ID NO: 45
  Description of Artificial Sequence: Synthetic polypeptide
  Polypeptide chain

SEQ ID NO: 94 - protein, 376 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGPGGPRAAAVKSPSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 95 - protein, 376 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPRAAAVKSPSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 96 - protein, 376 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGPGGPRAAAVKSPSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 97 - protein, 374 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSGRAAAVKSPSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 98 - protein, 376 aa, Artificial Sequence; identical to SEQ ID NO: 51
  Description of Artificial Sequence: Synthetic polypeptide
  Polypeptide chain

SEQ ID NO: 99 - protein, 376 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPAPTSSSTKKTQLQLEHLLLDLQMILNGINNYKNPKLTRMLTFKFYMPKKATELKHLQCLEERLKPLEEVLNLAQSKNFHLRPRDLISNINVIVLELKGSETTFMCEYADETATIVEFLNRWITFAQSIISTLT

SEQ ID NO: 100 - protein, 376 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPAPTSSSTKKTQLQLEHLLLDLQMILNGINNYKNPKLTRMLTEKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 101 - protein, 376 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPAPTSSSTKKTQLQLEHLLLDLQMILNGINNYKNPKLTRMLTFKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 102 - protein, 376 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPAPTSSSTKKTQLQLEHLLLDLQMILNGINNYKNPKLTRMLTAKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 103 - protein, 376 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPAPTSSSTKKTQLQLEHLLLDLQMILNGINNYKNPKLTRMLTFKFRMPKKATELKHLQCLEEELKPLEEVLNLAQSKNFHLRPRDLISNINVIVLELKGSETTFMCEYADETATIVEFLNRWITFAQSIISTLT

SEQ ID NO: 104 - protein, 376 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPAPTSSSTKKTQLQLEHLLLDLQMILNGINNYKNPKLTRMLTSKFYMPKKATELKHLQCLFFSLKPLFEVLNLAQSKNFHLRPRDLISNINVIVLELKGSFTTFMCEYADETATIVEFLNRWITFAQSIISTLT

SEQ ID NO: 105 - protein, 372 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLLLDLQMILNGINNYKNPKLTRMLTFKFYMPKKATELKHLQCLEERLKPLEEVLNLAQSKNFHLRPRDLISNINVIVLELKGSETTFMCEYADETATIVEFLNRWITFAQSIISTLT

SEQ ID NO: 106 - protein, 372 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLLLDLQMILNGINNYKNPKLTRMLTEKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 107 - protein, 372 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLLLDLQMILNGINNYKNPKLTRMLTFKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 108 - protein, 372 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLLLDLQMILNGINNYKNPKLTRMLTAKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 109 - protein, 372 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLLLDLQMILNGINNYKNPKLTRMLTFKFRMPKKATELKHLQCLEEELKPLEEVLNLAQSKNFHLRPRDLISNINVIVLELKGSETTFMCEYADETATIVEFLNRWITFAQSIISTLT

SEQ ID NO: 110 - protein, 372 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLLLDLQMILNGINNYKNPKLTRMLTSKFYMPKKATELKHLQCLEESLKPLEEVLNLAQSKNFHLRPRDLISNINVIVLELKGSETTFMCEYADETATFVEFLNRWITFAQSIISTLT

SEQ ID NO: 111 - protein, 372 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 112 - protein, 25 aa, Artificial Sequence
  Description of Artificial Sequence: Synthetic peptide
  Linker
GGSSGGSPISSGLLSGRSSGPGSGS

SEQ ID NO: 113 - protein, 22 aa, Artificial Sequence
  Description of Artificial Sequence: Synthetic peptide
  Linker
GPPSGSSPISSGLLSGRSSGGG

SEQ ID NO: 114 - protein, 19 aa, Artificial Sequence
  Description of Artificial Sequence: Synthetic peptide
  Linker
GGSGGSISSGLLSGRSSGP

SEQ ID NO: 115 - protein, 22 aa, Artificial Sequence
  Description of Artificial Sequence: Synthetic peptide
  Linker
GGSGGSGGSISSGLLSGRSSGP

SEQ ID NO: 116 - protein, 15 aa, Artificial Sequence
  Description of Artificial Sequence: Synthetic peptide
  Linker
GGGGSGGGGSGGGGS

SEQ ID NO: 117 - protein, 10 aa, Artificial Sequence
  Description of Artificial Sequence: Synthetic peptide
  Cytokine fragment
KSKREKKDRV

SEQ ID NO: 118 - protein, 18 aa, Artificial Sequence
  Description of Artificial Sequence: Synthetic peptide
  Linker
SGSDLLAVVAASSGPGSG

SEQ ID NO: 119 - protein, 23 aa, Artificial Sequence
  Description of Artificial Sequence: Synthetic peptide
  Linker
SGSPSGDLLAVVAASSGPGSGSP

SEQ ID NO: 120 - protein, 18 aa, Artificial Sequence
  Description of Artificial Sequence: Synthetic peptide
  Linker
GGSGISSGLLSGRSSSGP

SEQ ID NO: 121 - protein, 15 aa, Artificial Sequence
  Description of Artificial Sequence: Synthetic peptide
  Linker
GISSGLLSGRSSSGP

SEQ ID NO: 122 - protein, 328 aa, Artificial Sequence
  Description of Artificial Sequence: Synthetic polypeptide
  Cytokine
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 123 - protein, 219 aa, Artificial Sequence
  Description of Artificial Sequence: Synthetic polypeptide
  Cytokine
MCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 124 - protein, 306 aa, Artificial Sequence
  Description of Artificial Sequence: Synthetic polypeptide
  Cytokine
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 125 - protein, 197 aa, Artificial Sequence
  Description of Artificial Sequence: Synthetic polypeptide
  Cytokine
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 126 - protein, 7 aa, Artificial Sequence
  Description of Artificial Sequence: Synthetic peptide
  Cytokine fragment
KDNTERV

SEQ ID NO: 127 - protein, 8 aa, Artificial Sequence
  Description of Artificial Sequence: Synthetic peptide
  Cytokine fragment
KDNTEGRV

SEQ ID NO: 128 - protein, 662 aa, Artificial Sequence
  Description of Artificial Sequence: Synthetic polypeptide
  Masking moiety
MEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSDWLIFFASLGSFLSILLVGVLGYLGLNRAARHLCPPLPTPCASSAIEFPGGKETWQWINPVDFQEEASLQEALVVEMSWDKGERTEPLEKTELPEGAPELALDTELSLEDGDRCKAKM

SEQ ID NO: 129 - protein, 862 aa, Artificial Sequence
  Description of Artificial Sequence: Synthetic polypeptide
  Masking moiety
MAHTFRGCSLAFMFIITWLLIKAKIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAVQEYVVEWRELHPGGDTQVPLNWLRSRPYNVSALISENIKSYICYEIRVYALSGDQGGCSSILGNSKHKAPLSGPHINAITEEKGSILISWNSIPVQEQMGCLLHYRIYWKERDSNSQPQLCEIPYRVSQNSHPINSLQPRVTYVLWMTALTAAGESSHGNEREFCLQGKANWMAFVAPSICIAIIMVGIFSTHYFQQKVFVLLAALRPQWCSREIPDPANSTCAKKYPIAEEKTQLPLDRLLIDWPTPEDPEPLVISEVLHQVTPVFRHPPCSNWPQREKGIQGHQASEKDMMHSASSPPPPRALQAESRQLVDLYKVLESRGSDPKPENPACPWTVLPAGDLPTHDGYLPSNIDDLPSHEAPLADSLEELEPQHISLSVFPSSSLHPLTFSCGDKLTLDQLKMRCDSLML

SEQ ID NO: 130 - protein, 162 aa, Artificial Sequence
  Description of Artificial Sequence: Synthetic polypeptide
  Cytokine
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 131 - protein, 114 aa, Artificial Sequence
  Description of Artificial Sequence: Synthetic polypeptide
  Cytokine
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 132 - protein, 267 aa, Artificial Sequence
  Description of Artificial Sequence: Synthetic polypeptide
  Alpha domain
MAPRRARGCRTLGLPALLLLLLLRPPATRGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 133 - protein, 30 aa, Artificial Sequence
  Description of Artificial Sequence: Synthetic polypeptide
  Alpha domain fragment
MAPRRARGCRTLGLPALLLLLLLRPPATRG

SEQ ID NO: 134 - protein, 175 aa, Artificial Sequence
  Description of Artificial Sequence: Synthetic polypeptide
  Alpha domain fragment
ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTT

SEQ ID NO: 135 - protein, 23 aa, Artificial Sequence
  Description of Artificial Sequence: Synthetic peptide
  Alpha domain fragment
VAISTSTVLLCGLSAVSLLACYL

SEQ ID NO: 136 - protein, 39 aa, Artificial Sequence
  Description of Artificial Sequence: Synthetic polypeptide
  Alpha domain fragment
KSRQTPPLASVEMEAMEALPVTWGTSSRDEDLENCSHHL

SEQ ID NO: 137 - protein, 66 aa, Artificial Sequence
  Description of Artificial Sequence: Synthetic polypeptide
  Alpha domain
ITCPPPMSVEHADIWVKSYSLYSRERYICNSGFKRKAGTSSLTECVLNKATNVAHWTTPSLKCIRD

SEQ ID NO: 138 - protein, 66 aa, Artificial Sequence
  Description of Artificial Sequence: Synthetic polypeptide
  Alpha domain
ITCPPPMSVEHADIWVKSYSLYSRENYICNSGFKRKAGTSSLTECVLNKATNVAHWTTPSLKCIRD

SEQ ID NO: 139 - protein, 66 aa, Artificial Sequence
  Description of Artificial Sequence: Synthetic polypeptide
  Alpha domain
ITCPPPMSVEHADIWVKSYSLYSRERYICNSGFKQKAGTSSLTECVLNKATNVAHWTTPSLKCIRD

SEQ ID NO: 140 - protein, 66 aa, Artificial Sequence
  Description of Artificial Sequence: Synthetic polypeptide
  Alpha domain
ITCPPPMSVEHADIWVKSYSLYSRESYICNSGFKRKAGTSSLTECVLNKATNVAHWTTPSLKCIRD

SEQ ID NO: 141 - protein, 66 aa, Artificial Sequence
  Description of Artificial Sequence: Synthetic polypeptide
  Alpha domain
ITCPPPMSVEHADIWVKSYSLYSRERYICNSGFKSKAGTSSLTECVLNKATNVAHWTTPSLKCIRD

SEQ ID NO: 142 - protein, 66 aa, Artificial Sequence
  Description of Artificial Sequence: Synthetic polypeptide
  Alpha domain
ITCPPPMSVEHADIWVKSYSLYSRENYICNSGFKQKAGTSSLTECVLNKATNVAHWTTPSLKCIRD

SEQ ID NO: 143 - protein, 77 aa, Artificial Sequence
  Description of Artificial Sequence: Synthetic polypeptide
  Alpha domain
ITCPPPMSVEHADIWVKSYSLYSRERYICNSGFKRKAGTSSLTECVLNKATNVAHWTTPSLKCIRDPALVHQRPAPP

SEQ ID NO: 144 - protein, 102 aa, Artificial Sequence
  Description of Artificial Sequence: Synthetic polypeptide
  Alpha domain
ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAAS

SEQ ID NO: 145 - protein, 16 aa, Artificial Sequence
  Description of Artificial Sequence: Synthetic peptide
  Linker
RSGVPLSLYSGSGGGK

SEQ ID NO: 146 - protein, 14 aa, Artificial Sequence
  Description of Artificial Sequence: Synthetic peptide
  Linker
RSGMPYDLYHPSGK

SEQ ID NO: 147 - protein, 14 aa, Artificial Sequence
  Description of Artificial Sequence: Synthetic peptide
  Linker
RGPDSGGFMLTSGK

SEQ ID NO: 148 - protein, 15 aa, Artificial Sequence
  Description of Artificial Sequence: Synthetic peptide
  Linker
RGSGHEQLTVSGGSK

SEQ ID NO: 149 - protein, 14 aa, Artificial Sequence
  Description of Artificial Sequence: Synthetic peptide
  Linker
RSGRAAAVKSPSGK

SEQ ID NO: 150 - protein, 20 aa, Artificial Sequence
  Description of Artificial Sequence: Synthetic peptide
  Linker
RGSGISSGLLSGRSDNHSGK

SEQ ID NO: 151 - protein, 14 aa, Artificial Sequence
  Description of Artificial Sequence: Synthetic peptide
  Linker
RGDLLAVVAASGGK

SEQ ID NO: 152 - protein, 15 aa, Artificial Sequence
  Description of Artificial Sequence: Synthetic peptide
  Linker
RGGISSGLLSGRSGK

SEQ ID NO: 153 - protein, 227 aa, Artificial Sequence; identical to SEQ ID NO: 79
  Description of Artificial Sequence: Synthetic polypeptide
  Polypeptide chain

SEQ ID NO: 154 - protein, 362 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPGGGSSGGGSGPSGSPGNWVNVISDLKKIEDLIQSMHIDATLYTESDVHPSCKVTAMKCFLLELQVISLESGDASIHDTVENLIILAQNSLSSNGQVTESGCKECEELEEKNIKEFLQSFVHIVQMFINTS

SEQ ID NO: 155 - protein, 444 aa, Artificial Sequence; identical to SEQ ID NO: 39
  Description of Artificial Sequence: Synthetic polypeptide
  Polypeptide chain

SEQ ID NO: 156 - protein, 362 aa, Artificial Sequence; identical to SEQ ID NO: 154
  Description of Artificial Sequence: Synthetic polypeptide
  Polypeptide chain

SEQ ID NO: 157 - protein, 444 aa, Artificial Sequence; identical to SEQ ID NO: 39
  Description of Artificial Sequence: Synthetic polypeptide
  Polypeptide chain

SEQ ID NO: 158 - protein, 358 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGSGSDLLAVVAASSGPGSGNWVNVISDLKKIEDLIQSMHIDATLYTESDVHPSCKVTAMKCFLLELQVISLESGDASIHDTVENLIILAQNSLSSNGQVTESGCKECEELEEKNIKEFLQSFVHIVQMFINTS

SEQ ID NO: 159 - protein, 462 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGSGSPSGDLLAVVAASSGPGSGSPAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRSNISWEISQASHYFERHLEFEARTLSPGHTWEEAPLLTLKQKQEWISLETLTPDTQYEFQVRVKPLQGEFTTWSPWSQPLAFRTKPAALGKD

SEQ ID NO: 160 - protein, 362 aa, Artificial Sequence; identical to SEQ ID NO: 154
  Description of Artificial Sequence: Synthetic polypeptide
  Polypeptide chain

SEQ ID NO: 161 - protein, 444 aa, Artificial Sequence; identical to SEQ ID NO: 39
  Description of Artificial Sequence: Synthetic polypeptide
  Polypeptide chain

SEQ ID NO: 162 - protein, 365 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSGGSPISSGLLSGRSSGPGSGSNWVNVISDLKKIEDLIQSMHIDATLYTESDVHPSCKVTAMKCFLLELQVISLESGDASIHDTVENLIILAQNSLSSNGQVTESGCKECEELEEKNIKEFLQSFVHIVQMFINTS

SEQ ID NO: 163 - protein, 461 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGPPSGSSPISSGLLSGRSSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRSNISWEISQASHYFERHLEFEARTLSPGHTWEEAPLLTLKQKQEWISLETLTPDTQYEFQVRVKPLQGEFTTWSPWSQPLAFRTKPAALGKD

SEQ ID NO: 164 - protein, 362 aa, Artificial Sequence; identical to SEQ ID NO: 154
  Description of Artificial Sequence: Synthetic polypeptide
  Polypeptide chain

SEQ ID NO: 165 - protein, 6 aa, Artificial Sequence
  Description of Artificial Sequence: Synthetic peptide
  Linker
GGSGGS

SEQ ID NO: 166 - protein, 9 aa, Artificial Sequence
  Description of Artificial Sequence: Synthetic peptide
  Linker
GGSGGSGGS

SEQ ID NO: 167 - protein, 6 aa, Artificial Sequence
  Description of Artificial Sequence: Synthetic peptide
  Linker
PGGSGP

SEQ ID NO: 168 - protein, 5 aa, Artificial Sequence
  Description of Artificial Sequence: Synthetic peptide
  Linker
GGSPG

SEQ ID NO: 169 - protein, 8 aa, Artificial Sequence
  Description of Artificial Sequence: Synthetic peptide
  Linker
GGSGGGSG

SEQ ID NO: 170 - protein, 227 aa, Artificial Sequence; identical to SEQ ID NO: 79
  Description of Artificial Sequence: Synthetic polypeptide
  Polypeptide chain

SEQ ID NO: 171 - protein, 760 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSGGSGGSGGSGGSSGPIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKDNTEGRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 172 - protein, 527 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGSPGKIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRSTLYWRDEGLVLLNRLRYRPSNSRLWNMVNVTKAKGRHDLLDLKPFTEYEFQISSKLHLYKGSWSDWSESLRAQTPEE

SEQ ID NO: 173 - protein, 227 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 174 - protein, 527 aa, Artificial Sequence; identical to SEQ ID NO: 172
  Description of Artificial Sequence: Synthetic polypeptide
  Polypeptide chain

SEQ ID NO: 175 - protein, 760 aa, Artificial Sequence; identical to SEQ ID NO: 171
  Description of Artificial Sequence: Synthetic polypeptide
  Polypeptide chain

SEQ ID NO: 176 - protein, 527 aa, Artificial Sequence; identical to SEQ ID NO: 172
  Description of Artificial Sequence: Synthetic polypeptide
  Polypeptide chain

SEQ ID NO: 177 - protein, 760 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSGGSGGSVPLSLYSGPIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKDNTEGRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 178 - protein, 528 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGPGGSGPKIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRSTLYWRDEGLVLLNRLRYRPSNSRLWNMVNVTKAKGRHDLLDLKPFTEYEFQISSKLHLYKGSWSDWSESLRAQTPEE

SEQ ID NO: 179 - protein, 757 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSGGSVPLSLYSGPIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKDNTEGRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 180 - protein, 528 aa, Artificial Sequence; identical to SEQ ID NO: 178
  Description of Artificial Sequence: Synthetic polypeptide
  Polypeptide chain

SEQ ID NO: 181 - protein, 759 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSGGSMPYDLYHPSGPIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKDNTEGRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 182 - protein, 527 aa, Artificial Sequence; identical to SEQ ID NO: 172
  Description of Artificial Sequence: Synthetic polypeptide
  Polypeptide chain

SEQ ID NO: 183 - protein, 762 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSGGSGGSMPYDLYHPSGPIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKDNTEGRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 184 - protein, 528 aa, Artificial Sequence; identical to SEQ ID NO: 178
  Description of Artificial Sequence: Synthetic polypeptide
  Polypeptide chain

SEQ ID NO: 185 - protein, 759 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSGGSDSGGFMLTSGPIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKDNTEGRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 186 - protein, 527 aa, Artificial Sequence; identical to SEQ ID NO: 172
  Description of Artificial Sequence: Synthetic polypeptide
  Polypeptide chain

SEQ ID NO: 187 - protein, 762 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSGGSGGSDSGGFMLTSGPIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKDNTEGRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 188 - protein, 528 aa, Artificial Sequence; identical to SEQ ID NO: 178
  Description of Artificial Sequence: Synthetic polypeptide
  Polypeptide chain

SEQ ID NO: 189 - protein, 759 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSGGSRAAAVKSPSGPIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKDNTEGRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 190 - protein, 527 aa, Artificial Sequence; identical to SEQ ID NO: 172
  Description of Artificial Sequence: Synthetic polypeptide
  Polypeptide chain

SEQ ID NO: 191 - protein, 762 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSGGSGGSRAAAVKSPSGPIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKDNTEGRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 192 - protein, 530 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGSGGGSGKIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRSTLYWRDEGLVLLNRLRYRPSNSRLWNMVNVTKAKGRHDLLDLKPFTEYEFQISSKLHLYKGSWSDWSESLRAQTPEE

SEQ ID NO: 193 - protein, 761 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSGGSISSGLLSGRSSGPIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKDNTEGRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 194 - protein, 530 aa, Artificial Sequence; identical to SEQ ID NO: 192
  Description of Artificial Sequence: Synthetic polypeptide
  Polypeptide chain

SEQ ID NO: 195 - protein, 764 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSGGSGGSISSGLLSGRSSGPIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKDNTEGRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 196 - protein, 530 aa, Artificial Sequence; identical to SEQ ID NO: 192
  Description of Artificial Sequence: Synthetic polypeptide
  Polypeptide chain

SEQ ID NO: 197 - protein, 759 aa, Artificial Sequence; identical to SEQ ID NO: 189
  Description of Artificial Sequence: Synthetic polypeptide
  Polypeptide chain

SEQ ID NO: 198 - protein, 530 aa, Artificial Sequence; identical to SEQ ID NO: 192
  Description of Artificial Sequence: Synthetic polypeptide
  Polypeptide chain

SEQ ID NO: 199 - protein, 762 aa, Artificial Sequence; identical to SEQ ID NO: 191
  Description of Artificial Sequence: Synthetic polypeptide
  Polypeptide chain

SEQ ID NO: 200 - protein, 528 aa, Artificial Sequence; identical to SEQ ID NO: 178
  Description of Artificial Sequence: Synthetic polypeptide
  Polypeptide chain

SEQ ID NO: 201 - protein, 761 aa, Artificial Sequence; identical to SEQ ID NO: 193
  Description of Artificial Sequence: Synthetic polypeptide
  Polypeptide chain

SEQ ID NO: 202 - protein, 527 aa, Artificial Sequence; identical to SEQ ID NO: 172
  Description of Artificial Sequence: Synthetic polypeptide
  Polypeptide chain

SEQ ID NO: 203 - protein, 764 aa, Artificial Sequence; identical to SEQ ID NO: 195
  Description of Artificial Sequence: Synthetic polypeptide
  Polypeptide chain

SEQ ID NO: 204 - protein, 306 aa, Artificial Sequence; identical to SEQ ID NO: 124
  Description of Artificial Sequence: Synthetic polypeptide
  Cytokine

SEQ ID NO: 205 - protein, 303 aa, Artificial Sequence
  Description of Artificial Sequence: Synthetic polypeptide
  Cytokine
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKDNTERVFTDKTSATVICRKNASISVRAQDRYYSSSWSEWASVPCS

SEQ ID NO: 206 - protein, 304 aa, Artificial Sequence
  Description of Artificial Sequence: Synthetic polypeptide
  Cytokine
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKDNTEGRVFTDKTSATVICRKNASISVRAQDRYYSSSWSEWASVPCS

SEQ ID NO: 207 - protein, 306 aa, Artificial Sequence
  Description of Artificial Sequence: Synthetic polypeptide
  Cytokine
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCS

SEQ ID NO: 208 - protein, 304 aa, Artificial Sequence
  Description of Artificial Sequence: Synthetic polypeptide
  Cytokine
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKDNTEGRVFTDKTSATVICRKNASISVRAQDRYYSSSWSEWASVPCS

SEQ ID NO: 209 - protein, 197 aa, Artificial Sequence; identical to SEQ ID NO: 125
  Description of Artificial Sequence: Synthetic polypeptide
  Cytokine

SEQ ID NO: 210 - protein, 518 aa, Artificial Sequence
  Description of Artificial Sequence: Synthetic polypeptide
  Cytokine
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 211 - protein, 515 aa, Artificial Sequence
  Description of Artificial Sequence: Synthetic polypeptide
  Cytokine
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKDNTERVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 212 - protein, 516 aa, Artificial Sequence
  Description of Artificial Sequence: Synthetic polypeptide
  Cytokine
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKDNTEGRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 213 - protein, 518 aa, Artificial Sequence
  Description of Artificial Sequence: Synthetic polypeptide
  Cytokine
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 214 - protein, 516 aa, Artificial Sequence
  Description of Artificial Sequence: Synthetic polypeptide
  Cytokine
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKDNTEGRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 215 - protein, 213 aa, Artificial Sequence
  Description of Artificial Sequence: Synthetic polypeptide
  Masking moiety
CRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENP

SEQ ID NO: 216 - protein, 522 aa, Artificial Sequence
  Description of Artificial Sequence: Synthetic polypeptide
  Masking moiety
CRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSD

SEQ ID NO: 217 - protein, 189 aa, Artificial Sequence
  Description of Artificial Sequence: Synthetic polypeptide
  Masking moiety
KIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSL

SEQ ID NO: 218 - protein, 199 aa, Artificial Sequence
  Description of Artificial Sequence: Synthetic polypeptide
  Masking moiety
KIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIV

SEQ ID NO: 219 - protein, 296 aa, Artificial Sequence
  Description of Artificial Sequence: Synthetic polypeptide
  Masking moiety
KIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEE

SEQ ID NO: 220 - protein, 296 aa, Artificial Sequence
  Description of Artificial Sequence: Synthetic polypeptide
  Masking moiety
KIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRSTLYWRDEGLVLLNRLRYRPSNSRLWNMVNVTKAKGRHDLLDLKPFTEYEFQISSKLHLYKGSWSDWSESLRAQTPEE

SEQ ID NO: 221 - protein, 599 aa, Artificial Sequence
  Description of Artificial Sequence: Synthetic polypeptide
  Masking moiety
KIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAVQEYVVEWRELHPGGDTQVPLNWLRSRPYNVSALISENIKSYICYEIRVYALSGDQGGCSSILGNSKHKAPLSGPHINAITEEKGSILISWNSIPVQEQMGCLLHYRIYWKERDSNSQPQLCEIPYRVSQNSHPINSLQPRVTYVLWMTALTAAGESSHGNEREFCLQGKAN

SEQ ID NO: 222 - protein, 204 aa, Artificial Sequence
  Description of Artificial Sequence: Synthetic polypeptide
  Masking moiety
KIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPP

SEQ ID NO: 223 - protein, 162 aa, Artificial Sequence; identical to SEQ ID NO: 130
  Description of Artificial Sequence: Synthetic polypeptide
  Cytokine

SEQ ID NO: 224 - protein, 114 aa, Artificial Sequence; identical to SEQ ID NO: 131
  Description of Artificial Sequence: Synthetic polypeptide
  Cytokine

SEQ ID NO: 225 - protein, 114 aa, Artificial Sequence
  Description of Artificial Sequence: Synthetic polypeptide
  Cytokine
NWVNVISDLKKIEDLIQSMHIAATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 226 - protein, 114 aa, Artificial Sequence
  Description of Artificial Sequence: Synthetic polypeptide
  Cytokine
NWVNVISDLKKIEDLIQSMHIDATLYTESDVHPSCKVTAMKCFLLALQVISLESGDASIHDTVENLIILANNSLSSNGNVTESGCKECEELEEKNIKEFLQSFVHIVQMFINTS

SEQ ID NO: 227 - protein, 114 aa, Artificial Sequence
  Description of Artificial Sequence: Synthetic polypeptide
  Cytokine
NWVNVISDLKKIEDLIQSMHIDATLYTESDVHPSCKVTAMKCFLLALQVISLASGDASIHDTVENLIILANNSLSSNGNVTESGCKECEELEEKNIKEFLQSFVHIVQMFINTS

SEQ ID NO: 228 - protein, 114 aa, Artificial Sequence
  Description of Artificial Sequence: Synthetic polypeptide
  Cytokine
NWVNVISDLKKIEDLIQSMHIDATLYTESDVHPSCKVTAMKCFLLRLQVISLRSGDASIHDTVENLIILANNSLSSNGNVTESGCKECEELEEKNIKEFLQSFVHIVQMFINTS

SEQ ID NO: 229 - protein, 114 aa, Artificial Sequence
  Description of Artificial Sequence: Synthetic polypeptide
  Cytokine
NWVNVISDLKKIEDLIQSMHIDATLYTESDVHPSCKVTAMKCFLLSLQVISLSSGDASIHDTVENLIILANNSLSSNGNVTESGCKECEELEEKNIKEFLQSFVHIVQMFINTS

SEQ ID NO: 230 - protein, 114 aa, Artificial Sequence
  Description of Artificial Sequence: Synthetic polypeptide
  Cytokine
NWVNVISDLKKIEDLIQSMHIDATLYTESDVHPSCKVTAMKCFLLELQVISLASGDASIHDTVENLIILANNSLSSNGNVTESGCKECEELEEKNIKEFLQSFVHIVQMFINTS

SEQ ID NO: 231 - protein, 18 aa, Artificial Sequence
  Description of Artificial Sequence: Synthetic peptide
  Cytokine
NWVNVISDLKKIEDLIQS

SEQ ID NO: 232 - protein, 79 aa, Artificial Sequence
  Description of Artificial Sequence: Synthetic polypeptide
  Cytokine
KVTAMKCFLLELQVISLESGDASIHDTVENLIILANNSLSSNGNVTESGCKECEELEEKNIKEFLQSFVHIVQMFINTS

SEQ ID NO: 233 - protein, 114 aa, Artificial Sequence
  Description of Artificial Sequence: Synthetic polypeptide
  Cytokine
NWVNVISDLKKIEDLIQSMHIDATLYTESDVHPSCKVTAMKCFLLELQVISLESGDASIHDTVENLIILAQNSLSSNGNVTESGCKECEELEEKNIKEFLQSFVHIVQMFINTS

SEQ ID NO: 234 - protein, 114 aa, Artificial Sequence
  Description of Artificial Sequence: Synthetic polypeptide
  Cytokine
NWVNVISDLKKIEDLIQSMHIDATLYTESDVHPSCKVTAMKCFLLELQVISLESGDASIHDTVENLIILANNSLSSNGQVTESGCKECEELEEKNIKEFLQSFVHIVQMFINTS

SEQ ID NO: 235 - protein, 114 aa, Artificial Sequence
  Description of Artificial Sequence: Synthetic polypeptide
  Cytokine
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFIQTS

SEQ ID NO: 236 - protein, 114 aa, Artificial Sequence
  Description of Artificial Sequence: Synthetic polypeptide
  Cytokine
NWVNVISDLKKIEDLIQSMHIDATLYTESDVHPSCKVTAMKCFLLELQVISLESGDASIHDTVENLIILAQNSLSSNGQVTESGCKECEELEEKNIKEFLQSFVHIVQMFINTS

SEQ ID NO: 237 - protein, 114 aa, Artificial Sequence
  Description of Artificial Sequence: Synthetic polypeptide
  Cytokine
NWVNVISDLKKIEDLIQSMHIDATLYTESDVHPSCKVTAMKCFLLELQVISLESGDASIHDTVENLIILAQNSLSSNGNVTESGCKECEELEEKNIKEFLQSFVHIVQMFIQTS

SEQ ID NO: 238 - protein, 114 aa, Artificial Sequence
  Description of Artificial Sequence: Synthetic polypeptide
  Cytokine
NWVNVISDLKKIEDLIQSMHIDATLYTESDVHPSCKVTAMKCFLLELQVISLESGDASIHDTVENLIILANNSLSSNGQVTESGCKECEELEEKNIKEFLQSFVHIVQMFIQTS

SEQ ID NO: 239 - protein, 114 aa, Artificial Sequence
  Description of Artificial Sequence: Synthetic polypeptide
  Cytokine
NWVNVISDLKKIEDLIQSMHIDATLYTESDVHPSCKVTAMKCFLLELQVISLESGDASIHDTVENLIILAQNSLSSNGQVTESGCKECEELEEKNIKEFLQSFVHIVQMFIQTS

SEQ ID NO: 240 - protein, 213 aa, Artificial Sequence; identical to SEQ ID NO: 4
  Description of Artificial Sequence: Synthetic polypeptide
  Masking moiety

SEQ ID NO: 241 - protein, 213 aa, Artificial Sequence; identical to SEQ ID NO: 5
  Description of Artificial Sequence: Synthetic polypeptide
  Masking moiety

SEQ ID NO: 242 - protein, 15 aa, Artificial Sequence
  Description of Artificial Sequence: Synthetic peptide
  Linker
GSPDLLAVVAASSGP

SEQ ID NO: 243 - protein, 16 aa, Artificial Sequence
  Description of Artificial Sequence: Synthetic peptide
  Linker
GSPGDLLAVVAASSGP

SEQ ID NO: 244 - protein, 18 aa, Artificial Sequence
  Description of Artificial Sequence: Synthetic peptide
  Linker
GSGSPSDLLAVVAASSGP

SEQ ID NO: 245 - protein, 16 aa, Artificial Sequence
  Description of Artificial Sequence: Synthetic peptide
  Linker
GGPSDLLAVVAASSGP

SEQ ID NO: 246 - protein, 17 aa, Artificial Sequence
  Description of Artificial Sequence: Synthetic peptide
  Linker
GSGPSDLLAVVAASSGP

SEQ ID NO: 247 - protein, 18 aa, Artificial Sequence
  Description of Artificial Sequence: Synthetic peptide
  Linker
GSSGGPDLLAVVAASSGP

SEQ ID NO: 248 - protein, 9 aa, Artificial Sequence
  Description of Artificial Sequence: Synthetic peptide
  Cleavable peptide
DLLAVVAAS

SEQ ID NO: 249 - protein, 10 aa, Artificial Sequence
  Description of Artificial Sequence: Synthetic peptide
  Cleavable peptide
ISSGLLSGRS

SEQ ID NO: 250 - protein, 4 aa, Artificial Sequence
  Description of Artificial Sequence: Synthetic peptide
  Linker
GGPS

SEQ ID NO: 251 - protein, 5 aa, Artificial Sequence
  Description of Artificial Sequence: Synthetic peptide
  Linker
GSGPS

SEQ ID NO: 252 - protein, 6 aa, Artificial Sequence
  Description of Artificial Sequence: Synthetic peptide
  Linker
GSSGGP

SEQ ID NO: 253 - protein, 3 aa, Artificial Sequence
  Description of Artificial Sequence: Synthetic peptide
GSP

SEQ ID NO: 254 - protein, 6 aa, Artificial Sequence
  Description of Artificial Sequence: Synthetic peptide
  Linker
GSGSPS

SEQ ID NO: 255 - protein, 454 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGSPDLLAVVAASSGPAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 256 - protein, 455 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGSPGDLLAVVAASSGPAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 257 - protein, 456 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGSGSPSDLLAVVAASSGPAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 258 - protein, 375 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGPSDLLAVVAASSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 259 - protein, 376 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSGPSDLLAVVAASSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 260 - protein, 377 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSSGGPDLLAVVAASSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 261 - protein, 141 aa, Artificial Sequence
  Description of Artificial Sequence: Synthetic polypeptide
  Cleavage product
VVAASSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 262 - protein, 609 aa, Artificial Sequence
  Description of Artificial Sequence: Synthetic polypeptide
  Cleavage product
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPGGGSSGGGSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLTDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGSPDLLA

SEQ ID NO: 263 - protein, 610 aa, Artificial Sequence
  Description of Artificial Sequence: Synthetic polypeptide
  Cleavage product
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPGGGSSGGGSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLTDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGSPGDLLA

SEQ ID NO: 264 - protein, 612 aa, Artificial Sequence
  Description of Artificial Sequence: Synthetic polypeptide
  Cleavage product
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPGGGSSGGGSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLTDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGSGSPSDLLA

SEQ ID NO: 265 - protein, 376 aa, Artificial Sequence; identical to SEQ ID NO: 51
  Description of Artificial Sequence: Synthetic polypeptide
  Cleavage product

SEQ ID NO: 266 - protein, 239 aa, Artificial Sequence
  Description of Artificial Sequence: Synthetic polypeptide
  Cleavage product
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGPPSGSSPGDSGG

SEQ ID NO: 267 - protein, 376 aa, Artificial Sequence; identical to SEQ ID NO: 51
  Description of Artificial Sequence: Synthetic polypeptide
  Cleavage product

SEQ ID NO: 268 - protein, 239 aa, Artificial Sequence
  Description of Artificial Sequence: Synthetic polypeptide
  Cleavage product
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGPPSGSSPGVPLS

SEQ ID NO: 269 - protein, 376 aa, Artificial Sequence; identical to SEQ ID NO: 51
  Description of Artificial Sequence: Synthetic polypeptide
  Cleavage product

SEQ ID NO: 270 - protein, 238 aa, Artificial Sequence
  Description of Artificial Sequence: Synthetic polypeptide
  Cleavage product
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGPPSGSSPMPYD

SEQ ID NO: 271 - protein, 376 aa, Artificial Sequence; identical to SEQ ID NO: 51
  Description of Artificial Sequence: Synthetic polypeptide
  Cleavage product

SEQ ID NO: 272 - protein, 233 aa, Artificial Sequence
  Description of Artificial Sequence: Synthetic polypeptide
  Cleavage product
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGSPDLLA

SEQ ID NO: 273 - protein, 376 aa, Artificial Sequence; identical to SEQ ID NO: 51
  Description of Artificial Sequence: Synthetic polypeptide
  Cleavage product

SEQ ID NO: 274 - protein, 234 aa, Artificial Sequence
  Description of Artificial Sequence: Synthetic polypeptide
  Cleavage product
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGSPGDLLA

SEQ ID NO: 275 - protein, 376 aa, Artificial Sequence; identical to SEQ ID NO: 51
  Description of Artificial Sequence: Synthetic polypeptide
  Cleavage product

SEQ ID NO: 276 - protein, 236 aa, Artificial Sequence
  Description of Artificial Sequence: Synthetic polypeptide
  Cleavage product
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGSGSPSDLLA

SEQ ID NO: 277 - protein, 5 aa, Artificial Sequence
  Description of Artificial Sequence: Synthetic peptide
  Linker
GGGGS

SEQ ID NO: 278 - protein, 226 aa, Artificial Sequence; identical to SEQ ID NO: 9
  Description of Artificial Sequence: Synthetic polypeptide
  Fc

SEQ ID NO: 279 - protein, 226 aa, Artificial Sequence; identical to SEQ ID NO: 12
  Description of Artificial Sequence: Synthetic polypeptide
  Fc

SEQ ID NO: 280 - protein, 227 aa, Artificial Sequence
  Description of Artificial Sequence: Synthetic polypeptide
  Fc
TIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPCEEEMTKKQVTLWCMVTDFMPEDIYVEWTNNGKTELNYKNTEPVLDSDGSYFMYSKLRVEKKNWVERNSYSCSVVHEGLHNHHTTKSFSRTPG

SEQ ID NO: 281 - protein, 227 aa, Artificial Sequence
  Description of Artificial Sequence: Synthetic polypeptide
  Fc
TIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVCVLPPPEEEMTKKQVTLSCAVTDFMPEDIYVEWTNNGKTELNYKNTEPVLDSDGSYFMVSKLRVEKKNWVERNSYSCSVVHEGLHNHHTTKSFSRTPG

SEQ ID NO: 282 - protein, 243 aa, Artificial Sequence
  Description of Artificial Sequence: Synthetic polypeptide
  Fc
EVQLLESGGGLVQPGGSLRLSCAASGFTFSLFTMSVVVRQAPGKGLEVVVSAISGSGGSTYYADSVKGRFTISRDNSKNTLYLQMNSLRAEDTAVYYCAKSTHLYLFDYWGQGTLVTVSSGGGGSGGGGSGGGGSEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIK

SEQ ID NO: 283 - protein, 224 aa, Artificial Sequence
  Description of Artificial Sequence: Synthetic polypeptide
  Fc
VRSGCKPCICTVPEVSSVFIFPPKPKDVLTITLTPKVTCVVVAISKDDPEVQFSWFVDDVEVHTAQTQPREEQFNSTFRSVSELPIMHQDWLNGKEFKCRVNSAAFGAPIEKTISKTKGRPKAPQVYTIPPPKEQMAKDKVSLTCMITDFFPEDITVEWQWNGQPAENYDNTQPIMDTDGSYFVYSDLNVQKSNWEAGNTFTCSVLHEGLHNHHTEKSLSHSPG

SEQ ID NO: 284 - protein, 224 aa, Artificial Sequence
  Description of Artificial Sequence: Synthetic polypeptide
  Fc
VRSGCKPCICTVPEVSSVFIFPPKPKDVLTITLTPKVTCVVVAISKDDPEVQFSWFVDDVEVHTAQTQPREEQFNSTFRSVSELPIMHQDWLNGKEFKCRVNSAAFGAPIEKTISKTKGRPKAPQVYTIPPPKKQMAKDKVSLTCMITDFFPEDITVEWQWNGQPAENYKNTQPIMKTDGSYFVYSKLNVQKSNWEAGNTFTCSVLHEGLHNHHTEKSLSHSPG

SEQ ID NO: 285 - protein, 231 aa, Artificial Sequence
  Description of Artificial Sequence: Synthetic polypeptide
  Fc
EPKSSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 286 - protein, 229 aa, Artificial Sequence
  Description of Artificial Sequence: Synthetic polypeptide
  Fc
AKTDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 287 - protein, 234 aa, Artificial Sequence
  Description of Artificial Sequence: Synthetic polypeptide
  Fc
AKTEPKSSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 288 - protein, 231 aa, Artificial Sequence
  Description of Artificial Sequence: Synthetic polypeptide
  Fc
EPKSSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 289 - protein, 229 aa, Artificial Sequence
  Description of Artificial Sequence: Synthetic polypeptide
  Fc
AKTDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 290 - protein, 234 aa, Artificial Sequence
  Description of Artificial Sequence: Synthetic polypeptide
  Fc
AKTEPKSSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 291 - protein, 226 aa, Artificial Sequence; identical to SEQ ID NO: 10
  Description of Artificial Sequence: Synthetic polypeptide
  Fc

SEQ ID NO: 292 - protein, 226 aa, Artificial Sequence
  Description of Artificial Sequence: Synthetic polypeptide
  Fc
DKTHTCPPCPAPELLGGPSVFLFPPKPKDTLYITREPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 293 - protein, 226 aa, Artificial Sequence; identical to SEQ ID NO: 13
  Description of Artificial Sequence: Synthetic polypeptide
  Fc

SEQ ID NO: 294 - protein, 226 aa, Artificial Sequence
  Description of Artificial Sequence: Synthetic polypeptide
  Fc
DKTHTCPPCPAPELLGGPSVFLFPPKPKDTLYITREPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 295 - protein, 228 aa, Artificial Sequence
  Description of Artificial Sequence: Synthetic polypeptide
  Fc
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLYSRLTVDKSRWQEGNVFSCSVMHEALHNHYTQKSLSLSLG

SEQ ID NO: 296 - protein, 228 aa, Artificial Sequence
  Description of Artificial Sequence: Synthetic polypeptide
  Fc
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSRLTVDKSRWQEGNVFSCSVMHEALHNHYTQKSLSLSLG

SEQ ID NO: 297 - protein, 230 aa, Artificial Sequence
  Description of Artificial Sequence: Synthetic polypeptide
  Fc
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLYSRLTVDKSRWQEGNVFSCSVMHEALHNHYTQKSLSLSLGGP

SEQ ID NO: 298 - protein, 230 aa, Artificial Sequence
  Description of Artificial Sequence: Synthetic polypeptide
  Fc
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLYSRLTVDKSRWQEGNVFSCSVMHEALHNHYTQKSLSLSLGPG

SEQ ID NO: 299 - protein, 226 aa, Artificial Sequence; identical to SEQ ID NO: 8
  Description of Artificial Sequence: Synthetic polypeptide
  Fc

SEQ ID NO: 300 - protein, 226 aa, Artificial Sequence; identical to SEQ ID NO: 11
  Description of Artificial Sequence: Synthetic polypeptide
  Fc

SEQ ID NO: 301 - protein, 226 aa, Artificial Sequence
  Description of Artificial Sequence: Synthetic polypeptide
  Fc
DKTHTCPPCPAPELLGGPSVFLFPPKPKDTLMIARTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 302 - protein, 5 aa, Artificial Sequence
  Description of Artificial Sequence: Synthetic peptide
  Linker
PGSGS

SEQ ID NO: 303 - protein, 17 aa, Artificial Sequence
  Description of Artificial Sequence: Synthetic peptide
  Linker
GGSSPPGGGSSGGGSGP

SEQ ID NO: 304 - protein, 4 aa, Artificial Sequence
  Description of Artificial Sequence: Synthetic peptide
  Linker
GSPG

SEQ ID NO: 305 - protein, 4 aa, Artificial Sequence
  Description of Artificial Sequence: Synthetic peptide
  Linker
GSGP

SEQ ID NO: 306-307 - skipped (2 entries)

SEQ ID NO: 308 - protein, 8 aa, Artificial Sequence
  Description of Artificial Sequence: Synthetic peptide
  Linker
HHHHHHHH

SEQ ID NO: 309 - protein, 17 aa, Artificial Sequence
  Description of Artificial Sequence: Synthetic peptide
  Linker
GISSGLLSGRSDQPSGP

SEQ ID NO: 310 - protein, 9 aa, Artificial Sequence
  Description of Artificial Sequence: Synthetic peptide
  Linker
GPPSGSSPG

SEQ ID NO: 311 - protein, 14 aa, Artificial Sequence
  Description of Artificial Sequence: Synthetic peptide
  Linker
GISSGLLSGRSSGP

SEQ ID NO: 312 - protein, 8 aa, Artificial Sequence
  Description of Artificial Sequence: Synthetic peptide
  Linker
GPPSGSSP

SEQ ID NO: 313 - protein, 7 aa, Artificial Sequence
  Description of Artificial Sequence: Synthetic peptide
  Linker
PSGSSPG

SEQ ID NO: 314 - protein, 6 aa, Artificial Sequence
  Description of Artificial Sequence: Synthetic peptide
  Linker
GGSSPP

SEQ ID NO: 315 - protein, 4 aa, Artificial Sequence
  Description of Artificial Sequence: Synthetic peptide
  Linker
GGPS

SEQ ID NO: 316 - protein, 5 aa, Artificial Sequence
  Description of Artificial Sequence: Synthetic peptide
  Linker
GSGPS

SEQ ID NO: 317 - protein, 6 aa, Artificial Sequence
  Description of Artificial Sequence: Synthetic peptide
  Linker
GSSGGP

SEQ ID NO: 318 - skipped

SEQ ID NO: 319 - protein, 5 aa, Artificial Sequence
  Description of Artificial Sequence: Synthetic peptide
  Linker
SGSPS

SEQ ID NO: 320 - protein, 213 aa, Artificial Sequence; identical to SEQ ID NO: 4
  Description of Artificial Sequence: Synthetic polypeptide
  Masking moiety

SEQ ID NO: 321 - protein, 133 aa, Artificial Sequence; identical to SEQ ID NO: 3
  Description of Artificial Sequence: Synthetic polypeptide
  Cytokine

SEQ ID NO: 322 - protein, 6 aa, Artificial Sequence
  Description of Artificial Sequence: Synthetic peptide
  Cleavable peptide
VPLSLY

SEQ ID NO: 323 - protein, 8 aa, Artificial Sequence
  Description of Artificial Sequence: Synthetic peptide
  Cleavable peptide
DSGGFMLT

SEQ ID NO: 324 - protein, 213 aa, Artificial Sequence; identical to SEQ ID NO: 5
  Description of Artificial Sequence: Synthetic polypeptide
  Masking moiety

SEQ ID NO: 325 - protein, 18 aa, Artificial Sequence
  Description of Artificial Sequence: Synthetic peptide
  Cleavable peptide
NPMGSDPVNFKLLRVVNG

SEQ ID NO: 326 - protein, 214 aa, Artificial Sequence
  Description of Artificial Sequence: Synthetic polypeptide
  Masking moiety
AVKNCSHLECFYNSRANVSCMWSHEEALNVTTCHVHAKSNLRHWNKTCELTLVRQASWACNLILGSFPESQSLTSVDLLDINVVCWEEKGWRRVKTCDFHPFDNLRLVAPHSLQVLHIDTQRCNISWKVSQVSHYIEPYLEFEARRRLLGHSWEDASVLSLKQRQQWLFLEMLIPSTSYEVQVRVKAQRNNTGTWSPWSQPLTFRTRPADPMKE

SEQ ID NO: 327 - protein, 213 aa, Artificial Sequence
  Description of Artificial Sequence: Synthetic polypeptide
  Masking moiety
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWISLETLTPDTQYEFQVRVKPLQGEFTTWSPWSQPLAFRTKPAALGKD

SEQ ID NO: 328 - protein, 133 aa, Artificial Sequence
  Description of Artificial Sequence: Synthetic polypeptide
  Cytokine
APTSSSTKKTQLQLEHLLLDLQMILNGINNYKNPKLTAMLTAKFAMPKKATELKHLQCLEEALKPLEEVLNLAQSKNFHFDPRDVVSNINVFVLELKGSETTFMCEYADETATIVEFLNRWITFAQSIISTLT

SEQ ID NO: 329 - protein, 8 aa, Artificial Sequence
  Description of Artificial Sequence: Synthetic peptide
  Cleavable peptide
RAAAVKSP

SEQ ID NO: 330 - protein, 8 aa, Artificial Sequence
  Description of Artificial Sequence: Synthetic peptide
  Cleavable peptide
MPYDLYHP

SEQ ID NO: 331 - protein, 9 aa, Artificial Sequence
  Description of Artificial Sequence: Synthetic peptide
  Cleavable peptide
DLLAVVAAS

SEQ ID NO: 332-333 - skipped (2 entries)

SEQ ID NO: 334 - protein, 9 aa, Artificial Sequence
  Description of Artificial Sequence: Synthetic peptide
  Linker
GHHHHHHHH

SEQ ID NO: 335 - protein, 5 aa, Artificial Sequence
  Description of Artificial Sequence: Synthetic peptide
  Linker
GSGGG

SEQ ID NO: 336 - protein, 4 aa, Artificial Sequence
  Description of Artificial Sequence: Synthetic peptide
  Linker
SGGG

SEQ ID NO: 337 - protein, 133 aa, Artificial Sequence; identical to SEQ ID NO: 62
  Description of Artificial Sequence: Synthetic polypeptide
  Cytokine

SEQ ID NO: 338 - protein, 133 aa, Artificial Sequence; identical to SEQ ID NO: 74
  Description of Artificial Sequence: Synthetic polypeptide
  Cytokine

SEQ ID NO: 339 - protein, 133 aa, Artificial Sequence
  Description of Artificial Sequence: Synthetic polypeptide
  Cytokine
APTSSSTKKTQLQLRHLCLRLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFCQSIISTLT

SEQ ID NO: 340 - protein, 133 aa, Artificial Sequence
  Description of Artificial Sequence: Synthetic polypeptide
  Cytokine
APTSSSTKKTQLQLRHLCLRLQMILNGINNYKNPKLTAMLTAKFAMPKKATELKHLQCLEEALKPLEEVLNLAQSKNFHLRPRDLISLINVIVLELKGSETTFMCEYADETATIVEFLNRWITFCQSIISTLT

SEQ ID NO: 341 - protein, 133 aa, Artificial Sequence
  Description of Artificial Sequence: Synthetic polypeptide
  Cytokine
APTSSSTKKTQLQLLHLCLRLQMILNGINNYKNPKLTAMLTAKFAMPKKATELKHLQCLEEALKPLEEVLNLAQSKNFHLRPRDLISLINVIVLELKGSETTFMCEYADETATIVEFLNRWITFCQSIISTLT

SEQ ID NO: 342 - protein, 133 aa, Artificial Sequence
  Description of Artificial Sequence: Synthetic polypeptide
  Cytokine
APTSSSTKKTQLQLRHLCLDLQMILNGINNYKNPKLTAMLTAKFAMPKKATELKHLQCLEEALKPLEEVLNLAQSKNFHLRPRDLISLINVIVLELKGSETTFMCEYADETATIVEFLNRWITFCQSIISTLT

SEQ ID NO: 343 - protein, 133 aa, Artificial Sequence
  Description of Artificial Sequence: Synthetic polypeptide
  Cytokine
APTSSSTKKTQLQLEHLCLRLQMILNGINNYKNPKLTAMLTAKFAMPKKATELKHLQCLEEALKPLEEVLNLAQSKNFHLRPRDLISLINVIVLELKGSETTFMCEYADETATIVEFLNRWITFCQSIISTLT

SEQ ID NO: 344 - protein, 133 aa, Artificial Sequence
  Description of Artificial Sequence: Synthetic polypeptide
  Cytokine
APTSSSTKKTQLQLFHLCLRLQMILNGINNYKNPKLTAMLTAKFAMPKKATELKHLQCLEEALKPLEEVLNLAQSKNFHLRPRDLISLINVIVLELKGSETTFMCEYADETATIVEFLNRWITFCQSIISTLT

SEQ ID NO: 345 - protein, 133 aa, Artificial Sequence
  Description of Artificial Sequence: Synthetic polypeptide
  Cytokine
APTSSSTKKTQLQLEHLCLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFCQSIISTLT

SEQ ID NO: 346 - protein, 133 aa, Artificial Sequence
  Description of Artificial Sequence: Synthetic polypeptide
  Cytokine
APTSSSTKKTQLQLEYLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 347 - protein, 133 aa, Artificial Sequence
  Description of Artificial Sequence: Synthetic polypeptide
  Cytokine
APTSSSTKKTQLQLEELLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 348 - protein, 133 aa, Artificial Sequence
  Description of Artificial Sequence: Synthetic polypeptide
  Cytokine
APTSSSTKKTQLQLEHLLLLLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 349 - protein, 133 aa, Artificial Sequence
  Description of Artificial Sequence: Synthetic polypeptide
  Cytokine
APTSSSTKKTQLQLEYLCLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFCQSIISTLT

SEQ ID NO: 350 - protein, 133 aa, Artificial Sequence
  Description of Artificial Sequence: Synthetic polypeptide
  Cytokine
APTSSSTKKTQLQLEELCLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFCQSIISTLT

SEQ ID NO: 351 - protein, 133 aa, Artificial Sequence
  Description of Artificial Sequence: Synthetic polypeptide
  Cytokine
APTSSSTKKTQLQLEHLCLLLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFCQSIISTLT

SEQ ID NO: 352 - protein, 133 aa, Artificial Sequence
  Description of Artificial Sequence: Synthetic polypeptide
  Cytokine
APTSSSTKKTQLQLEYLCLLLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFCQSIISTLT

SEQ ID NO: 353 - protein, 133 aa, Artificial Sequence
  Description of Artificial Sequence: Synthetic polypeptide
  Cytokine
APTSSSTKKTQLQLEELCLLLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFCQSIISTLT

SEQ ID NO: 354 - protein, 444 aa, Artificial Sequence; identical to SEQ ID NO: 38
  Description of Artificial Sequence: Synthetic polypeptide
  Polypeptide chain

SEQ ID NO: 355 - protein, 376 aa, Artificial Sequence; identical to SEQ ID NO: 51
  Description of Artificial Sequence: Synthetic polypeptide
  Polypeptide chain

SEQ ID NO: 356 - protein, 372 aa, Artificial Sequence; identical to SEQ ID NO: 49
  Description of Artificial Sequence: Synthetic polypeptide
  Polypeptide chain

SEQ ID NO: 357 - protein, 374 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSGPDSGGFMLTSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 358 - protein, 374 aa, Artificial Sequence; identical to SEQ ID NO: 48
  Description of Artificial Sequence: Synthetic polypeptide
  Polypeptide chain

SEQ ID NO: 359 - protein, 444 aa, Artificial Sequence; identical to SEQ ID NO: 39
  Description of Artificial Sequence: Synthetic polypeptide
  Polypeptide chain

SEQ ID NO: 360 - protein, 380 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGNPMGSDPVNFKLLRVVNGGPAPTSSSTKKTQLQLEHLLLDLQMILNGINNYKNPKLTRMLTSKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 361 - protein, 377 aa, Artificial Sequence
  Description of Artificial Sequence: Synthetic polypeptide
  Polypeptide chain
TIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPCEEEMTKKQVTLWCMVTDFMPEDIYVEWTNNGKTELNYKNTEPVLDSDGSYFMYSKLRVEKKNWVERNSYSCSVVHEGLHNHHTTKSFSRTPGGGSSPPGGGSSGGGSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 362 - protein, 373 aa, Artificial Sequence
  Description of Artificial Sequence: Synthetic polypeptide
  Polypeptide chain
TIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPCEEEMTKKQVTLWCMVTDFMPEDIYVEWTNNGKTELNYKNTEPVLDSDGSYFMYSKLRVEKKNWVERNSYSCSVVHEGLHNHHTTKSFSRTPGGSPGVPLSLYSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 363 - protein, 445 aa, Artificial Sequence
  Description of Artificial Sequence: Synthetic polypeptide
  Polypeptide chain
TIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVCVLPPPEEEMTKKQVTLSCAVTDFMPEDIYVEWTNNGKTELNYKNTEPVLDSDGSYFMVSKLRVEKKNWVERNSYSCSVVHEGLHNHHTTKSFSRTPGPGSGSAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 364 - protein, 690 aa, Artificial Sequence
  Description of Artificial Sequence: Synthetic polypeptide
  Polypeptide chain
EVQLLESGGGLVQPGGSLRLSCAASGFTFSLFTMSVVVRQAPGKGLEVVVSAISGSGGSTYYADSVKGRFTISRDNSKNTLYLQMNSLRAEDTAVYYCAKSTHLYLFDYWGQGTLVTVSSGGGGSGGGGSGGGGSEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIKGGSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGPGSGSAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 365 - protein, 235 aa, Artificial Sequence
  Description of Artificial Sequence: Synthetic polypeptide
  Polypeptide chain
TIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVCVLPPPEEEMTKKQVTLSCAVTDFMPEDIYVEWTNNGKTELNYKNTEPVLDSDGSYFMVSKLRVEKKNWVERNSYSCSVVHEGLHNHHTTKSFSRTPGHHHHHHHH

SEQ ID NO: 366 - protein, 454 aa, Artificial Sequence
  Description of Artificial Sequence: Synthetic polypeptide
  Polypeptide chain
TIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVCVLPPPEEEMTKKQVTLSCAVTDFMPEDIYVEWTNNGKTELNYKNTEPVLDSDGSYFMVSKLRVEKKNWVERNSYSCSVVHEGLHNHHTTKSFSRTPGPGSGSAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDGHHHHHHHH

SEQ ID NO: 367 - protein, 455 aa, Artificial Sequence
  Description of Artificial Sequence: Synthetic polypeptide
  Polypeptide chain
TIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVCVLPPPEEEMTKKQVTLSCAVTDFMPEDIYVEWTNNGKTELNYKNTEPVLDSDGSYFMVSKLRVEKKNWVERNSYSCSVVHEGLHNHHTTKSFSRTPGPGSGSAVKNCSHLECFYNSRANVSCMWSHEEALNVTTCHVHAKSNLRHWNKTCELTLVRQASWACNLILGSFPESQSLTSVDLLDINVVCWEEKGWRRVKTCDFHPFDNLRLVAPHSLQVLHIDTQRCNISWKVSQVSHYIEPYLEFEARRRLLGHSWEDASVLSLKQRQQWLFLEMLIPSTSYEVQVRVKAQRNNTGTWSPWSQPLTFRTRPADPMKEGHHHHHHHH

SEQ ID NO: 368 - protein, 444 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGPGSGSAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWISLETLTPDTQYEFQVRVKPLQGEFTTWSPWSQPLAFRTKPAALGKD

SEQ ID NO: 369 - protein, 374 aa, Artificial Sequence
  Description of Artificial Sequence: Synthetic polypeptide
  Polypeptide chain
VRSGCKPCICTVPEVSSVFIFPPKPKDVLTITLTPKVTCVVVAISKDDPEVQFSWFVDDVEVHTAQTQPREEQFNSTFRSVSELPIMHQDWLNGKEFKCRVNSAAFGAPIEKTISKTKGRPKAPQVYTIPPPKEQMAKDKVSLTCMITDFFPEDITVEWQWNGQPAENYDNTQPIMDTDGSYFVYSDLNVQKSNWEAGNTFTCSVLHEGLHNHHTEKSLSHSPGGGSSPPGGGSSGGGSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 370 - protein, 370 aa, Artificial Sequence
  Description of Artificial Sequence: Synthetic polypeptide
  Polypeptide chain
VRSGCKPCICTVPEVSSVFIFPPKPKDVLTITLTPKVTCVVVAISKDDPEVQFSWFVDDVEVHTAQTQPREEQFNSTFRSVSELPIMHQDWLNGKEFKCRVNSAAFGAPIEKTISKTKGRPKAPQVYTIPPPKEQMAKDKVSLTCMITDFFPEDITVEWQWNGQPAENYDNTQPIMDTDGSYFVYSDLNVQKSNWEAGNTFTCSVLHEGLHNHHTEKSLSHSPGGSPGVPLSLYSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 371 - protein, 442 aa, Artificial Sequence
  Description of Artificial Sequence: Synthetic polypeptide
  Polypeptide chain
VRSGCKPCICTVPEVSSVFIFPPKPKDVLTITLTPKVTCVVVAISKDDPEVQFSWFVDDVEVHTAQTQPREEQFNSTFRSVSELPIMHQDWLNGKEFKCRVNSAAFGAPIEKTISKTKGRPKAPQVYTIPPPKKQMAKDKVSLTCMITDFFPEDITVEWQWNGQPAENYKNTQPIMKTDGSYFVYSKLNVQKSNWEAGNTFTCSVLHEGLHNHHTEKSLSHSPGPGSGSAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 372 - protein, 443 aa, Artificial Sequence
  Description of Artificial Sequence: Synthetic polypeptide
  Polypeptide chain
VRSGCKPCICTVPEVSSVFIFPPKPKDVLTITLTPKVTCVVVAISKDDPEVQFSWFVDDVEVHTAQTQPREEQFNSTFRSVSELPIMHQDWLNGKEFKCRVNSAAFGAPIEKTISKTKGRPKAPQVYTIPPPKKQMAKDKVSLTCMITDFFPEDITVEWQWNGQPAENYKNTQPIMKTDGSYFVYSKLNVQKSNWEAGNTFTCSVLHEGLHNHHTEKSLSHSPGPGSGSAVKNCSHLECFYNSRANVSCMWSHEEALNVTTCHVHAKSNLRHWNKTCELTLVRQASWACNLILGSFPESQSLTSVDLLDINVVCWEEKGWRRVKTCDFHPFDNLRLVAPHSLQVLHIDTQRCNISWKVSQVSHYIEPYLEFEARRRLLGHSWEDASVLSLKQRQQWLFLEMLIPSTSYEVQVRVKAQRNNTGTWSPWSQPLTFRTRPADPMKE

SEQ ID NO: 373 - protein, 376 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGISSGLLSGRSDQPSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 374 - protein, 459 aa, Artificial Sequence; identical to SEQ ID NO: 42
  Description of Artificial Sequence: Synthetic polypeptide
  Polypeptide chain

SEQ ID NO: 375 - protein, 372 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLLLDLQMILNGINNYKNPKLTAMLTAKFAMPKKATELKHLQCLEEALKPLEEVLNLAQSKNFHFDPRDVVSNINVFVLELKGSETTFMCEYADETATIVEFLNRWITFAQSIISTLT

SEQ ID NO: 376 - protein, 373 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGISSGLLSGRSSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 377 - protein, 376 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPGGGSSGGGSGPAPTSSSTKKTQLQLEHLLLDLQMILNGINNYKNPKLTAMLTAKFAMPKKATELKHLQCLEEALKPLEEVLNLAQSKNFHFDPRDVVSNINVFVLELKGSETTFMCEYADETATIVEFLNRWITFAQSIISTLT

SEQ ID NO: 378 - protein, 449 aa, Artificial Sequence
  Description of Artificial Sequence: Synthetic polypeptide
  Polypeptide chain
EPKSSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGPGSGSAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 379 - protein, 447 aa, Artificial Sequence
  Description of Artificial Sequence: Synthetic polypeptide
  Polypeptide chain
AKTDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGPGSGSAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 380 - protein, 452 aa, Artificial Sequence
  Description of Artificial Sequence: Synthetic polypeptide
  Polypeptide chain
AKTEPKSSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGPGSGSAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 381 - protein, 377 aa, Artificial Sequence
  Description of Artificial Sequence: Synthetic polypeptide
  Polypeptide chain
EPKSSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 382 - protein, 375 aa, Artificial Sequence
  Description of Artificial Sequence: Synthetic polypeptide
  Polypeptide chain
AKTDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 383 - protein, 380 aa, Artificial Sequence
  Description of Artificial Sequence: Synthetic polypeptide
  Polypeptide chain
AKTEPKSSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 384 - protein, 460 aa, Artificial Sequence; identical to SEQ ID NO: 41
  Description of Artificial Sequence: Synthetic polypeptide
  Polypeptide chain

SEQ ID NO: 385 - protein, 372 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLRHLCLRLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFCQSIISTLT

SEQ ID NO: 386 - protein, 372 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLRHLCLRLQMILNGINNYKNPKLTAMLTAKFAMPKKATELKHLQCLEEALKPLEEVLNLAQSKNFHLRPRDLISLINVIVLELKGSETTFMCEYADETATIVEFLNRWITFCQSIISTLT

SEQ ID NO: 387 - protein, 372 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLLHLCLRLQMILNGINNYKNPKLTAMLTAKFAMPKKATELKHLQCLEEALKPLEEVLNLAQSKNFHLRPRDLISLINVIVLELKGSETTFMCEYADETATIVEFLNRWITFCQSIISTLT

SEQ ID NO: 388 - protein, 372 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLRHLCLDLQMILNGINNYKNPKLTAMLTAKFAMPKKATELKHLQCLEEALKPLEEVLNLAQSKNFHLRPRDLISLINVIVLELKGSETTFMCEYADETATIVEFLNRWITFCQSIISTLT

SEQ ID NO: 389 - protein, 372 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLCLRLQMILNGINNYKNPKLTAMLTAKFAMPKKATELKHLQCLEEALKPLEEVLNLAQSKNFHLRPRDLISLINVIVLELKGSETTFMCEYADETATIVEFLNRWITFCQSIISTLT

SEQ ID NO: 390 - protein, 372 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLFHLCLRLQMILNGINNYKNPKLTAMLTAKFAMPKKATELKHLQCLEEALKPLEEVLNLAQSKNFHLRPRDLISLINVIVLELKGSETTFMCEYADETATIVEFLNRWITFCQSIISTLT

SEQ ID NO: 391 - protein, 444 aa, Artificial Sequence; identical to SEQ ID NO: 43
  Description of Artificial Sequence: Synthetic polypeptide
  Polypeptide chain

SEQ ID NO: 392 - protein, 444 aa, Artificial Sequence
  Description of Artificial Sequence: Synthetic polypeptide
  Polypeptide chain
DKTHTCPPCPAPELLGGPSVFLFPPKPKDTLYITREPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGPGSGSAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 393 - protein, 376 aa, Artificial Sequence
  Description of Artificial Sequence: Synthetic polypeptide
  Polypeptide chain
DKTHTCPPCPAPELLGGPSVFLFPPKPKDTLMASRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPGGGSSGGGSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 394 - protein, 376 aa, Artificial Sequence
  Description of Artificial Sequence: Synthetic polypeptide
  Polypeptide chain
DKTHTCPPCPAPELLGGPSVFLFPPKPKDTLYITREPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPGGGSSGGGSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 395 - protein, 372 aa, Artificial Sequence; identical to SEQ ID NO: 50
  Description of Artificial Sequence: Synthetic polypeptide
  Polypeptide chain

SEQ ID NO: 396 - protein, 372 aa, Artificial Sequence
  Description of Artificial Sequence: Synthetic polypeptide
  Polypeptide chain
DKTHTCPPCPAPELLGGPSVFLFPPKPKDTLYITREPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 397 - protein, 372 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLCLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFCQSIISTLT

SEQ ID NO: 398 - protein, 372 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEYLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 399 - protein, 372 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEELLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 400 - protein, 372 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLLLLLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 401 - protein, 372 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEYLCLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFCQSIISTLT

SEQ ID NO: 402 - protein, 372 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEELCLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFCQSIISTLT

SEQ ID NO: 403 - protein, 372 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLCLLLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFCQSIISTLT

SEQ ID NO: 404 - protein, 372 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEYLCLLLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFCQSIISTLT

SEQ ID NO: 405 - protein, 372 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEELCLLLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFCQSIISTLT

SEQ ID NO: 406 - protein, 446 aa, Artificial Sequence
  Description of Artificial Sequence: Synthetic polypeptide
  Polypeptide chain
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLYSRLTVDKSRWQEGNVFSCSVMHEALHNHYTQKSLSLSLGPGSGSAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 407 - protein, 378 aa, Artificial Sequence
  Description of Artificial Sequence: Synthetic polypeptide
  Polypeptide chain
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSRLTVDKSRWQEGNVFSCSVMHEALHNHYTQKSLSLSLGGGSSPPGGGSSGGGSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 408 - protein, 374 aa, Artificial Sequence
  Description of Artificial Sequence: Synthetic polypeptide
  Polypeptide chain
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSRLTVDKSRWQEGNVFSCSVMHEALHNHYTQKSLSLSLGGSPGVPLSLYSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 409 - protein, 459 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGPPSGSSPRAAAVKSPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 410 - protein, 459 aa, Artificial Sequence
  Description of Artificial Sequence: Synthetic polypeptide
  Polypeptide chain
DKTHTCPPCPAPELLGGPSVFLFPPKPKDTLMASRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGPPSGSSPMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 411 - protein, 459 aa, Artificial Sequence
  Description of Artificial Sequence: Synthetic polypeptide
  Polypeptide chain
DKTHTCPPCPAPELLGGPSVFLFPPKPKDTLMASRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGPPSGSSPGVPLSLYGSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 412 - protein, 459 aa, Artificial Sequence; identical to SEQ ID NO: 40
  Description of Artificial Sequence: Synthetic polypeptide
  Polypeptide chain

SEQ ID NO: 413 - protein, 460 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGPPSGSSPGDSGGFMLTSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRSNISWEISQASHYFERHLEFEARTLSPGHTWEEAPLLTLKQKQEWISLETLTPDTQYEFQVRVKPLQGEFTTWSPWSQPLAFRTKPAALGKD

SEQ ID NO: 414 - protein, 461 aa, Artificial Sequence
  Description of Artificial Sequence: Synthetic polypeptide
  Polypeptide chain
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLYSRLTVDKSRWQEGNVFSCSVMHEALHNHYTQKSLSLSLGGPPSGSSPGVPLSLYGSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 415 - protein, 376 aa, Artificial Sequence
  Description of Artificial Sequence: Synthetic polypeptide
  Polypeptide chain
DKTHTCPPCPAPELLGGPSVFLFPPKPKDTLMASRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 416 - protein, 375 aa, Artificial Sequence
  Description of Artificial Sequence: Synthetic polypeptide
  Polypeptide chain
DKTHTCPPCPAPELLGGPSVFLFPPKPKDTLMASRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGPSDLLAVVAASSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 417 - protein, 376 aa, Artificial Sequence
  Description of Artificial Sequence: Synthetic polypeptide
  Polypeptide chain
DKTHTCPPCPAPELLGGPSVFLFPPKPKDTLMASRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSGPSDLLAVVAASSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 418 - protein, 377 aa, Artificial Sequence
  Description of Artificial Sequence: Synthetic polypeptide
  Polypeptide chain
DKTHTCPPCPAPELLGGPSVFLFPPKPKDTLMASRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSSGGPDLLAVVAASSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 419 - protein, 454 aa, Artificial Sequence; identical to SEQ ID NO: 255
  Description of Artificial Sequence: Synthetic polypeptide
  Polypeptide chain

SEQ ID NO: 420 - protein, 455 aa, Artificial Sequence; identical to SEQ ID NO: 256
  Description of Artificial Sequence: Synthetic polypeptide
  Polypeptide chain

SEQ ID NO: 421 - protein, 456 aa, Artificial Sequence; identical to SEQ ID NO: 257
  Description of Artificial Sequence: Synthetic polypeptide
  Polypeptide chain

SEQ ID NO: 422 - protein, 444 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGPGSGSAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 423 - protein, 376 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPGGGSSGGGSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 424 - protein, 372 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 425 - protein, 459 aa, Artificial Sequence
  Description of Artificial Sequence: Synthetic polypeptide
  Polypeptide chain
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGPPSGSSPGVPLSLYGSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 426 - protein, 376 aa, Artificial Sequence
  Description of Artificial Sequence: Synthetic polypeptide
  Polypeptide chain
DKTHTCPPCPAPELLGGPSVFLFPPKPKDTLMIARTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPGGGSSGGGSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 427 - protein, 372 aa, Artificial Sequence
  Description of Artificial Sequence: Synthetic polypeptide
  Polypeptide chain
DKTHTCPPCPAPELLGGPSVFLFPPKPKDTLMIARTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 428 - protein, 375 aa, Artificial Sequence; identical to SEQ ID NO: 258
  Description of Artificial Sequence: Synthetic polypeptide
  Polypeptide chain

SEQ ID NO: 429 - protein, 376 aa, Artificial Sequence; identical to SEQ ID NO: 259
  Description of Artificial Sequence: Synthetic polypeptide
  Polypeptide chain

SEQ ID NO: 430 - protein, 377 aa, Artificial Sequence; identical to SEQ ID NO: 260
  Description of Artificial Sequence: Synthetic polypeptide
  Polypeptide chain

SEQ ID NO: 431 - protein, 6 aa, Artificial Sequence
  Description of Artificial Sequence: Synthetic peptide
  Fc domain
LALAPG

SEQ ID NO: 432 - protein, 8 aa, Artificial Sequence
  Description of Artificial Sequence: Synthetic peptide
  Fc domain
AKTEPKSS

SEQ ID NO: 433 - protein, 4 aa, Artificial Sequence
  Description of Artificial Sequence: Synthetic peptide
  Fc domain
DAPG

SEQ ID NO: 434 - protein, 5 aa, Artificial Sequence
  Description of Artificial Sequence: Synthetic peptide
  Fc domain
EPKSS

SEQ ID NO: 435 - protein, 6 aa, Artificial Sequence
  Description of Artificial Sequence: Synthetic peptide
GGGGGS

SEQ ID NO: 436 - protein, 15 aa, Artificial Sequence
  Description of Artificial Sequence: Synthetic peptide
  MOD_RES (7)..(12): Any amino acid
GGSGGSXXXXXXSGP

SEQ ID NO: 437 - protein, 18 aa, Artificial Sequence
  Description of Artificial Sequence: Synthetic peptide
  MOD_RES (10)..(15): Any amino acid
GGSGGSGGSXXXXXXSGP

SEQ ID NO: 438 - protein, 8 aa, Artificial Sequence
  Description of Artificial Sequence: Synthetic peptide
VPLSLYSG

SEQ ID NO: 439 - protein, 8 aa, Artificial Sequence
  Description of Artificial Sequence: Synthetic peptide
VPLSLYSG

SEQ ID NO: 440 - protein, 8 aa, Artificial Sequence
  Description of Artificial Sequence: Synthetic peptide
MPYDLYHP

SEQ ID NO: 441 - protein, 10 aa, Artificial Sequence
  Description of Artificial Sequence: Synthetic peptide
ISSGLLSGRS

SEQ ID NO: 442 - protein, 8 aa, Artificial Sequence
  Description of Artificial Sequence: Synthetic peptide
DSGGFMLT

SEQ ID NO: 443 - protein, 8 aa, Artificial Sequence
  Description of Artificial Sequence: Synthetic peptide
RAAAKKSP

SEQ ID NO: 444 - protein, 8 aa, Artificial Sequence
  Description of Artificial Sequence: Synthetic peptide
DLLAVVAA

SEQ ID NO: 445 - protein, 9 aa, Artificial Sequence
  Description of Artificial Sequence: Synthetic peptide
ISSGLLSGR

The invention claimed is:

1. A masked interleukin 12 (IL-12) cytokine comprising:
a first polypeptide chain comprising a first Fc domain, and a masking moiety comprising the amino acid sequence of SEQ ID NO: 220;
a second polypeptide chain comprising a second Fc domain, a first linker comprising a proteolytically cleavable peptide of SEQ ID NO: 249, and an IL-12 cytokine comprising an IL-12p40 polypeptide linked to an IL-12p35 polypeptide; and
wherein the IL-12p40 polypeptide comprises the amino acid sequence of SEQ ID NO: 208 and the IL-12p35 polypeptide comprises the amino acid sequence of SEQ ID NO: 209.

2. The masked IL-12 cytokine of claim 1, wherein the IL-12p40 polypeptide is linked to the IL-12p35 polypeptide via a second linker comprising the amino acid sequence of SEQ ID NO: 116.

3. The masked IL-12 cytokine of claim 1, wherein the first Fc domain comprises the amino acid sequence of SEQ ID NO: 8.

4. The masked IL-12 cytokine of claim 3, wherein the second Fc domain comprises the amino acid sequence of SEQ ID NO: 11.

5. The masked IL-12 cytokine of claim 1, wherein the first Fc domain comprises the amino acid sequence of SEQ ID NO: 9.

6. The masked IL-12 cytokine of claim 5, wherein the second Fc domain comprises the amino acid sequence of SEQ ID NO: 12.

7. The masked IL-12 cytokine of claim 1, wherein the first linker comprises the amino acid sequence of SEQ ID NO: 115.

8. The masked IL-12 cytokine of claim 1, wherein the first polypeptide chain comprises a non-cleavable linker between the first Fc domain and the masking moiety, and wherein the non-cleavable linker comprises the amino acid sequence of SEQ ID NO: 35.

9. The masked IL-12 cytokine of claim 1, wherein the first polypeptide chain comprises the amino acid sequence of SEQ ID NO: 192.

10. The masked IL-12 cytokine of claim 1, wherein the second polypeptide chain comprises the amino acid sequence of SEQ ID NO: 195.

11. A masked IL-12 cytokine comprising a first polypeptide chain comprising the amino acid sequence of SEQ ID NO: 192 and a second polypeptide chain comprising the amino acid sequence of SEQ ID NO: 195.

* * * * *